United States Patent 7,625,699 (GENETIC POLYMORPHISMS ASSOCIATED WITH CORONARY STENOSIS, METHODS OF DETECTION AND USES THEREOF) - sequence listing, part 8

SEQ ID NO: 12373 - DNA, 201037 bp, Homo sapiens
gtacggccacttaaaaaatggcagtttcttataatactaaacagattcttataatatgatccagcaatcaagctccttcgtatttccccaatgagctgaaaatttatgctcacacaaaaacctgaatacagatgtttataacagttttatttatcacagccaaaattagaagcaaccaacatgtccttcagtaggtgaatagacaaataaactgtactacatctagacaatggaatattattcagcattgaaaagaaatgaactatcaagccataaaaagacatggaggaaccataacttcttattaagaaagaagctgattttagccgggcgtggtggctcacgcctgtaatctcagcactttgggaggccgaggcgggcagatcacgaagtcaggagatcggaccatcctggctaaggcggtgaaaccccgtctctactaaaaatacaaaaaattagctgggcgtggtggcaggcgtctgtagtcccagctactcgggaggctgaggcaggagaatggtgtgaagccgggaggcggagcttgcagtgagccgcgactgcgccactgcgctccagcctgggcgacagagcgagactccgtctcaaaaaaaaaaaaaaaaaaaaaaaaaaaaaaaaaaagctgattttgaagggctgtatattgtatgattctgactatataacattccagaaaaggcaaaactatgaagatggtaagaagatcagtagttgtcaggtaggagggcaggatgaataggcaaagcacagaggatttttaggacactattctgtgataatatagtggtggatacatgtcatgttacttttgttaaaactcatagaatgcacaacaccaaggttgaatcctaatgtgaactatacatttggggtaacaatgatgtgtccacgtagcttcatccgtggtaacaaatgtaccactttgatgtgggatattgatgattgaggggaggccatgcatgttatgcatgtcttggggcaggaggtacaggaatagtctgtactttccattcaattttgctgtgaaccaaaaactgctctaaaaaataagtctattgaaaagaatcaaaatatttaaaaatgagtcaatcaattaaacagtttagttcaatatagagcctcaaaaaaaccttaatatccttaattttaagaaatacacaaatgagcttatccatacaacaaatgaaaattttcaattcaagataggattttaacaaatcctgtgtttgggagggcttctacaggctgaatatttgtccttcctccaaaattcatatgttgaaacctaatccccattgcagtggtatttggaggtgggccctttgggagataattaggtcatgagggtggagccctcgtgaataggattaatgtctcatacaaggggctccagagaactgccttgccgcttgaacacatgagattcttgcaagaagatggccatccatgatccaggaatttggccctcatcagacaccaaatctaacaatttcttgatcttgtacttctcagcctccagaacagtgagaaatagattcctaattataagccactcagactagtattttgttttagctgcctgagtgaacttagaataaacccaagatctttgccatgatgacatgttttctttttaagggagaaaaaactgaaatctaagtaatattcatccagaagtaattttcaaagtttatgattatcttttataaccactgtttcattgaaaatatacaaaatacagaataatattattctactgatacgatgagaaagaattatcttgaatcttgtactgtatcaaatattcctgaaatggaaaaaatgattcctacctttttgtgttttttaatataatgttctcactgaattcttgaatataacaggtttaaattactttacagtcaatcctgacaagatactaaaaggctaagaatgtaacatgctgtggttttcctatcaaacataattatgcctccttcagatggactcagggtgccacatcactcttagctctggagctatcagtgaggaccctcctacttgttttatgcctgatactggaaaaatgcaataacaggccatctgggccactaggaacaaagatgcaaagctcaggcaggtaggaatgaactgctttttaagcagaaagttctagtaggacaaatccaaataaaagatttgtctatgctacaggaagtaaaattagtctttaatgttttcagaaatttcacattacaagaatactaagtagatgtcattgtgtcaatcagatgtgaacaaaatttttaaggtgtaaaacacaagataaatctagcctcatagtctaaaatacattgttccatgtaaaatgagatctatttctgacaaacaccttataattaccaaagctgtattttacttcaaaagaaataactatgactttctcagtttgtaaacatttgattcaattcagtgacttctgttcgtatttaacatctgttcaaatagatttttcaatgacaatggataaaaatgagcaaaaatgtatgtgagcctaacataaacaatttattgttataagaaaaacagatatttcacttcccatttaatttcatagtttattcagtgactatacaatattctatagtcactgtgttataacatggaagtgttgtaagaagcacttccaccaaatttaagtcaaacagattctgcaaagttaacatctccttttccccatttccatctacctatatttatgttagggacactttggaaataatttgtagagtaaggaaacttatggaaaactatggacattttataatcacaagtgaccaaccctgatattagaaaattctcagacacaacaaaatagattgccagattttgctaataaaaatacagagcaactagttaaacttgggtttcagataaacattaatttttttaaatataagaatgtcccaaatattgcatgagagtatataaaaattatttattgtgtgtctgaaattcaaatttcactgggcatcctctcttttatcaggcaatactatgcagagacattttagtagtgatgcttttctctcctattagaatgtgagtccctttatggcagagatgaaataattcgttatgcatcagtgtgtgatacataatgaacacacacaacagaattgtattaaatgaaaaactgaatgtaaagaacaaattttaaagaccctcaaatttgttctcttttagaaaactcttgagttttgaaatttttgtcaaatcttccattatgcaaccgctatctacctccagaaatattccttttccttgtaggttcaactaatataatctcttctcatctctttgtttaaactgttcatatgaaacagtatattatatttattgagagtgataagactcccagagctttggcttatacatgagtttggatttacaaaatgctccaggatggtatgtaggtgaggataaaatgtacctagtttaccaagctaatgttttagatataggttctgtttgtctctgtctctgcctctttctgttctgtctctgtttttctacatatattctctctgaatacatgtatacataaatttatatatatatgtatactctgaatgaaggtgtgtggttttgcaagttcataactttaactcacaatggctaatgcacattaatcaggtaccatgtctcagaaatgactatgaccccagtaacactgtgaactgtgagatacagtacatttttgatgtttctgctctgctgatgccttctcttctcccatgccttggctgttacagtgacctatattccaaggacctcaacctcctactccatcatccctcccagagatcatcagaaccacattcactggtcctccagtcagtttcccacagctgtcattcagtctcacagaattggcctctatcctgaatcccatacaaacctcaatagcaacatgactactccctccaggtggcttttgtgccttcccagggaatgacagtaatattaactatgagaacaaaattagcagaaatcacatattccccttccctttttactagggaaatttatttcaacagtgttgttgtttggtgatctaattcaaaagattgacaagtgatgtgatttttttgtccagtaagagaaaactcagggttatggtggttgttggattattcttgcaggctactggggtatccttgataattggaacctactggaacaccataattcccctaagcaaaccaagcttcccctaaatagcagaagttcttaggagtttcttttgtggtccctcctgtgttgtatttcacatataagctgctccactgggaaatcaatgtttgtcacagtctgaccccactcaatctgctcaaatgtaattcacactgtttttttaatggcatatgacatctgcttctttccttcctgtcctcactgcctttgacatggtttttttccctgctagtccttcttgtttaactacacatctctaggaaagctttcctgcctactccagtcaatattaaataaaactttctctgaactctcagtgcacagtcagtttatacacctgcatacttcttgtaatgctagcaaaaaaaaatggcccccaaattttcttcctatatggaaactcacatgagcagccatcaatccccatcataattcttgtaaaagttgtagcatttctatttctgttcatggaaagaataagatcaaggatcaacttcttaatattgatatgtgtttctgaataaacactaaatggtttcaaaatctgttattacatgactataatctattcctgaagcaacagcaaactgccattagcttgcacatttagccaaatgttcacaggctgggatattagcaagaactcgtagtaacacttgaaatacattcagaacccaattttatgtgcaggaagttttctttaaaatttttaaagctagaatactatttttgagacaagaacaggacacaagagtatacactgtacagatacctacwtcaaattgttactaagaatacatgggataattccacaacttggctttctgtgccttagatgggactcctaaaaggctctaaagtgggtctcatatacgaaaaacatgtactaatagttaaaggatatcatataaatgaaaatctcataaattttcagtgtagagactaccaccaattaccttctcattatttccttttggcttcaaattaattcaacaaatattcagggaacacctattgattttttttaaggccattttgctaggatctggggttatagtaataaaggtaaactccctgccatcaaggcgctcacagtctaattctgaacaccaccaaagaaaagagcacatgagggtgacatttccagctctaaggcagcagaaggtatgcattatacattttttgcatacccttcaatcaagcaataaaaaatcttcccgttcgaccctgtgggaggaggcacttgtgtggttcggtctggcaggaccaccgccgtgttgaaagtccccccagacagctgtgcccagcacggcagtttcgttggggtctagggaaagggcagggtcagactggtcacaatcagggctggagattttttggagtcaactctcccaaaggcaatggggtctactgctttattaggaaaatggaaagaaaaaagggagggaaacaatgtacccaggcgcccccaccgcattctgattggacccacttaagcatctgcagaaaacaataaaatgaaaaaaactcttagaggtgaaactcaaaggtcaacctctggctgtgcgggacaatgggtgtccggccttcccttcccttcccttccgaagtgatgaaggagttccaatgttctgcgaacactggaaaccccagcggatccctctaactccagggcagcgaaaccactggcagcggacagagggaggattgtcggtgtgtgaattgctaccctgggatccggacccagagcggcagccgcgcccctccgccccccgcgcgaccccgggtccgaggcacgctcccagcggagcggtcctgcgcccccgccccctccaggmgccgcggcgcgcacagccgggctggagcgcgcacccggcactgaggcttcgctgctctcggagcgctcagaccgcggccgccgcagccggcgaaagaggcaaagtcccgcacgccggaggacatgcgcctcggctagcggccccgggccccaccaccgtgcggctttctcsagattattcctctctcgctgtctctgactgtctctctctgtctctgtctctstctctctctctctcwcacacacacacacacacacaaacacacatacgcacgcacgatctcacttcgatctatacactggaggattaaaacaaacaaacaaaaaaaacatttcyttcgctccccctccctctccactctgagaagcagaggagccgcacggcgaggggccgcagaccgtctggaaatgcgaakcctaaagcktttcctcgcttgcattcagctcctctgtgtttgccgcctgggtgagtgagaagagctcggtggggtttcagctccgggatcggtgggatgagggtgggagcatttcagcgtgtccgcgacttgccgccgccgccgccatctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctcttttgcaaagtgtagaaatcgccttttagatatacataggaagataaatgaccagaaatacagctgtggtgcggggctgtgtactgtactgtcttttttgctgttcatttttatgctataggtatgatgggcttaaatggaaagtacacgtgtctggtgtgaattgcagmcacacacacacacacacacacacacctgaaaggtagtaacaggcacaagcaccaacctgacttttcagggttttttttattactttcaatttagtcatattcaagtctgcgcaattacttacaaaaaaaaaagttccatctaaatctctaggtttggtcagtgctgccaaagtcagaggagagctgcaggttgatatacttattcacagatttcatttttcatctgcaccctccaggttacatttaaaactgaaattgcattcagcaatagccagtttaagcattccctttacctgcgatgcagactcaagttttccagtcattttcgagaagtgcaagattggacttttgcgttttattaaagaaatgctttttttccttcatgattttccatcgcgatagaatataatgggtttacgcattaacctgaaagttacaaagtgttgtacttcgctttgtgagtacacatatttaattcttttcagaggctcccaatttttcaattttagatggttcatagtagagtagatattaagcgtacattttcatccaatagatggtgctgctyttggcacagtaacctttacaaacagaaactatttttaagttctaataaatgaaaattacattgcaaatacggtgataattgcccatagacccccacacacggacataatttaaatttcaaaggctttatgaaagtgcttggggtggtgtgatgcatagttgacacataagacatgcaagggaatctctggtctccattgattctaaaaccttatrgtcagttctggagaggggaagacagctttaaaaagtacgtggtcatcaaacatctgttgaattcacatttctattgtagatctattttaacaaagaaggcaggtcctcttagtaattaaattatgtaagtaaatatcacagtagcaaggaaataaaccagagagtattgctttgtatgtcttcaaaaccacatgcccagagcatgttgcggatctctttgaaaaaaaaaaaaagataaaattcacacattatacaattcatctttttaaaatggtccagtggtttttaatatattcgtgaagttgtgcagccatcaccactaattccagaatgttttaatgaccccaaaaagaaaccccatgttccttagcagccattccccattctccatgaccccagctcctagcaaccactaatctactttctgtctctataaatttgcctatcctggacatttcatataaatagaatcatgcaacttgtggccttttctgtctgtctttgttcacttggcataatgttttcagtttcatccatgttatagtatgtataagtacttcattcctttttgtggctgagtaatattccattatgccaatatactaaatatatcacatttgcaaaggtttttctctgtaaagcattatttgtagcctatttttggttgtatagttttcagtttgttggacattttctttaagtctttggtgatgtaaaatttaagtgtaaagaatttaattaacttttaaagactatcacaagcttatgtaatgctactgaatgtaagcttgcattggaactccaagtgagttttgttgagactggaaggtgactactttwgtattcctcaccattttaacaaagttggccttttacacagttgccaacaggctgacctggaggcattggcaacatcaagtaacataaatatcttgatcttggggcagcatgttttgaaaaagtgaggcacattatcttcaaatgaaaaagttaggctccatttcaattatttttcactcagcacctacttcagtgtttgtggatgcgtttacccctcatcttcagtgttcttagagccaatgaggtagcctgacatatgtattaagtgctcagtaagggtctgtcaactgactaaaacttgctgyacaggagaagagctcaatacaatttgaacattaggctgtcattcttaccattatccaggaacaagttgtagagttcactaagatattgattattggcaattaagaatgtcttagtgatcagatcagatcattttgtatctaaaatgtcctgatgttttgaactggacataatagaccaactgcttctttcaaataactttccagacaaaaaatttatcagaatacatgaaccaaaacaaatttttcttgacccactgaacaggtgtatcttatgggaaaaactacagtggctttcctgtaaggaggcttaactatgagtcatagaggagaggtagatattttaagagcttttaaggaataatttcttccaattaatgaaggaattcaggatctttgaattaagtgaattatagtgctgcaaggtacactaagttcaaatgtttaagtattattattaaatatgtaatgaatcagattctgwacttctcagtcacatcttactgctttaagagccacattaacaataaattatacccaactcctctggaagaattaacttcttaatttatgctggttatagagtctgtgaaattcaatatgttgtgactctcagtttgatctatttatcctctgaaaacaaattgtaaccacatataaaaaatattcatgcctttttcccaaatartaactagcctctattcagaaaattaattccttttcattgcagagttgcaattttctttatttcatttctctctcctttttacgtatactgtggttgcttccagtcagggaagtttgccaggagaaatcatttcattgatgaattcatttctactctcatgtctgcactagagattcaagatcttgcttaaaattttatgttgtgggaattttgcttctggcaaaaattcaggtttttctggaagcataagctgcgttttctcattccctttaactccgaaaagatttgagtactgtctaaagtgagagatttgcttgaccacccatttgctgaccgttcagactgttgcatggaaatggaaccccctcagtcaggaccagaagatctcaaaggaaggcataattaagaagatgagcctgtgtttcattttcagttaccatctgctcaagtgtctactaggtgcagtttcagcactgagcattttatgtacattttctcatttcattctcctcaaaaccctttgatattggtgttttcatcttayaccttttacaaatgagggaacccggcacagagaactcagataagttgcctaacatcacaaatcctgattcagcctgtgtattccttcccaatccagagcctgaggcttttcctcttttcattcccaggatcaatttgctgtttggcattcactagcttgctttcatgtgatgtgatggtacatttcacagtcccatttgcttttctgaggatccctttcatgattttgcccatgtactcttgtattacttttttatccttttttgaaaattaaggcataatttacatttttaccatcttgaaagttttcaccgatgcatatggtcatgtagcaatcactgtgatccagatacagaatcgttccagccatgctactttaactactcattcactagatgttcactaagtgcccgacatctgcaaggcaccatgctaggcgctgataattcagctatgcatcaacatacagagacttaaactcatgatgctcacaacccagttaatctgattcaatcccacaatgaaaactttctttaaatcttgttttaaagatactttttctgttcacaactagtcgaaaataagtcttttccaaatatctcttaatgtgttgaatatgttaactctcaaatactttaaaatgcttcctgctccattaagaattccaatggtaaaagtcagagccaatttaaacaagagagagatatgtgtgtatatacatatataaatgtatatatatgcatatacataaaagtgtatatatatatatgtgtttgtgtatatatatataaaatatatacatttaaattgtatttcaacttttagtgtcttattgagattaattcctagaagtaacttcagrttacaaaaggaaaccaatttttctctgtgtttaaagaaattaaagaaattaaagaaagaaaaaatatcatatagcacaatcttaaaacacttgtattttagaaatgtcctgtttaataccatagccactaggcagatgtagctatgtaatttaaaatttattaaaataaaacaattcagttccctaatcacaccatccacatttcaagtgctcagtaatctgtgtggctagtggcaatcacatgggacagtgcagacatggaacatctccatctggcagtgttgttttggaacaacaacaaaaaacgctggtaaaataatgattgatagaactcatgaggagtcatcaactcaactagaaaaatttctaaagtcattgaaattgtttgaagtgttcgtgcatgtgagttagttatggtttgtgttgtgttagcctgcaaacatcctagaaacatgatggggcctttggtagagcagtaataggtgaaaagagttcagtggccactttgtagcctttatggactgaggttgaacagaagagattaactgctggttcgggagtgagtgctctgctcccatagtacattttccataatttgttctgttatccactgtattgtttttcaatttatctgtctccttgactcgaccacattatttgagggtaaagaatccattcttacattcatcattcattcattgttaaattcattcattgaagaattcaatgaaaaattcagtcaacattgcattcttgaacttagcacttacagtaggtgccaataaatctttaatgtataaggttatagaaagattgtaccatgaagcttcttagaaaaaaaaatagttgtttgttgttgagactggccaattttcactggtctttccctcttttgattatgatctcagtccgggagtaaggtcagcattcaccttgacctgtccatctttaatgtcayttctggtacgcgaacttcactttcactgattctcccagaaatacacgtaagcatataggcatcctctatgaggttggagctgtcatgaatgtgattaatgcctgtacaagcattacatagatccagacactatctgtgcatggaaaataaagttcctgtgattgatactgagtgtgtacttacagaagcagtcttgagtgagcttttaattctagaggagttggcaccaatgagttttggatacatcccagggggccagaacatcaagtcagctagtgtgccactttgtatgtgtacaagtgcatgcgcctgtgctgctctggtgttggggaggagagggcaatgagggatgcaggatggtcagtaatgagtaaataaagtatcttgagcccatgaacactgtattttcagtcagccaaaagctatcatattggtttaagtcttctctagtcaagaaggccgtaagagatagtgacacaaaacagttttgaaaaccaggcaaatgatgggaagtgcagttttatcatgtggatgtacgtgcttttggagtttgtcaatagttttatcattaatcctagagaggatgtgctacacaagtttaactctgcacatagcaaatatttgaactgagttgaattcaaatggaatgggayatgggatcagttaaaaatcttcataggagtcaaaagcagaaaaaaaggagatgatcttttgttaggatatttgctttattttcttctcaactaccttcctcccttccttttttctttccctccttccttctatttttccttccttcccctttcctcccttcttccctcccttcctccttttatccttcattcctttaatccttccttcttttctttttctttttttgttgctatttcctcttcagcttcactttcttttagcatgagtttaagataattaaataaacttaagtttgctcagcaccttgatgaaaagtttgatagggaagagattaatgctatttgaaaccattagttaaaaatatttttactgtgttaatatcatttgggggtctttgtagttaacaaaatttttaaagtatgagttggcagatgtttttgcctaaatattccagtgtggtaaaatgggctgattgtctttgttttccccttctgatatttgcccacagatattaaagtaaactcagttattttgggtactggttaatgtgaagtttttggccttattcaataagtacaagtcaatttatgtgcatgctaacaggggatagttttttttacaagtttccttggaaatgtagtacttgggtacttggaaataatttattcattagtaagaaagaaggattttctgttagaatatccataactatgatgagaatacagatattttcctgctcttggagaaacattctaccctctctctctgccttcccctttagcacttactggataaattttctactttttcactgttactgactgaactgcctatttcttgaatcctaaagctctaatgtatttacctaaggatgggtctcactatgagctcttttctctgaactgattaactcagtaccttgagtaggaataaaataaaacattgatttttaaaatgactcctttaagcagagatcatggtaataaacagagtcttgattacatgcttagaacatgctggccagatataaggaagtttttagattttctaatggtttttattcatattgtcatcagattgaaaattatttctattattaaatttttacccacttgcattctgacacattttcttgaataggatatgtcaaggtggtattgtctcagctgctacacagagttgtgcaaaatcatgatctgcccaaaggagcataaggatacccttgaggagcatgtgggatattattgtcatgtgtgttttagtgcacaaaaacgctgacaaccatttatctaggttgataattctcaatcctggctgcattttgaacttacttggtgttatggactgaatgtttgtgtcctctccaaaattcatgttgaagccctaacctgccattgtgatcgtatttggggacagggcctttgcagggtaattaggtcatgagggtgaagctgtcattgatgggtttagtgtctgtataagaagagaaaaagaccagaatcctctctctattcaccatgtaaagacacagcaagaaggcagccatctgcaatccagaaagagagccctcgccaggaatcaaatctgctggccttttgatcttaaacttcccagcctccatatctgtgagaaataaatgtctgttatgttagccacccagtaaatggtattttgttatagtagcccaagctgactatgcacctgggagacttttaaatcatactgatgcctgggcatcaaatcaagtacttcataatgtatgggtgctgagcccagacatggacattttcttaaaactctccaggtgattatagagcacagcctgggactgaaaccacagatctaggccaacttcatgacactactaatcttagttcatttttcttaaggtggagatatttgcaggtcttatgctgtcctaaaacaaagctagtgccacaagacaaaggtcctggaaattttcccttctctctctcttcttaaggcagtttcagcttcagagtaaccctagaaggaggagtatgctctatggtgattgacctcatagtcttttaaagccagggaaactttaggaggccaggcagtcttggagtgggtccaaagattcaagtctatcagctggtaggagggtaaatgaaccagcttccgagatggggactccaagtgacatttatccagacacaagcacataatatcgttcatttcatcaatgatacatattcttgttctctgttatttattttctttctccatgcataatttgttagaacttggctttttgtttactgttatgaaataaatattaagatttagctattgctttttcattttagcaatttgtgtgttttatgaaattattaatcaggtataggctatttctttttactgtatttgaaaagcaccaataactccatttaaaaattaacaatgaacttttctaggtgtttcaaataactcctttaatatacttattagtgatgatgcaagtacaaattaatttaatgaatcatttttgagcatcttccttgggataaatattcctccagagagactattcttctcatggccagctgaacttttacaagatagaaagatgcatacgtaagtaggtctcatacatgatggagtttctggcatatgagactgtgagctgtgtggagatatatttagtcttaaattcacctcttagaaggtttctagtaggagatgggattggatatagaccattcaggataaatggatagagcttcaggggtcaccatgggagcagaaggcatcagagggattaaggttggcatgcagagaaacatggactgaaagtgagaacgtggtaattggagggaggggacagtggggagaggagtataacagtaaaaggtctcaaatggtaggtaggatttacaatggccaattgaagagttttgtgtttgaaatctactcattgtacaatgggaaattactaaagggttttgagcagtgaaatgactggaatagatctctttatttcaggaagataactcaggtatcagagcataggatggattgaagccgagggagacagggaatcaggaagcttggttaaaagcctcttacacggtggcagtcacagtggaaatttatagatcatttgggatataataatatcatcctctttatagaattctttaatgtttaacaagcactttcagatacattatctcacttgatatgaatgtaattggtataattggtaggacattgtgccattctctggagtgagtcactggtgatccttaagggagtgtcttctctgggaaggtgaagatgtagcatggaacacagggaatcagagaaatatccaggaaggaaaagagaaggtagcaaatacatacaagtccacagaagttgataacttggagggaagaaagaagagagagaaacagaggatgatcgcttgaaacctgattatttattgaatggtgaaactcttaaatttgttaagacaaggcagtaattgactctagacattttctctgaacagattaactcagtgccttgagtagaaataagaggaaatagtgctgctaaaaatgattattttttttagagattagagtcacaacttaactaaaacaagcaaacttttttaaaggaggattttagtatatttatagtttcaggttaatcttatcaaatgccaatatgaaaactacttacttcattcacctttcaaagccttgtatttgtcatttttacagtgaacacatgtactattgggacatttcagccagcattctgccagtacacaggctttcttaaccacaagttcagattacttgaaggccatcatatttatgtccataaactagcatctttgtaaattgcttacaacttgtattttatataaaaatagtgtaatggaaaataatgcatagattaggcttctcagaatttgtttaaaaattgactttggcagttttcgttgttgctgtttttgagacggagtttcactcttgttgcccaggctggagtgcaatggtgcgatcttggctcactgcaacctccacctcctgggttcaagtgagtctcctgcctcagcctcccaagtatctgggattacaggcatgtgccaccatgcccagctaattttgtatttttagtagagatggggtttctccatattggtcagggtggcctctaactcccaacctcaggtggtccaccctcctcggcctcccaaagtgctgggattacaggtgtgagccactgtgcctggctagctttttctttaattcatgaaaaatacataggattgtttactctatgtctcttaagatacattaagatacatgaattggtaaattaatcaattactaagtttaggaaagagagaaggcagcagctgtcaagactgaaatgtaagcatattttttccttatgtaatgaaaaaatatagacagttgtgctatatatgagttgaatgccaaacttttgtctattttaaaagtatgactgaatcgattttcaatagaagtatttggttactgtaaagtttcctttgatggctttcaggtggggaaatgacatgtaatggtttatatatataaatacatttatataagtatgttatatggaaacatatatgtatatgtgcatatatgcatctatatacacacctaaataaggacacatataaatgcatatatgtaagtgcatatatatacacaaatgcacgtgtatatttcatatatatgcattttttttcctgctgctaaaaactgatactgctttattttgaatgttaaaagattacatcctttggaaacatcattatgtttaattgtagcmtatattctgggtattttgagcctgacattttcctgcctccaacataaaggrcagaaagaatgccgcttcttcctgtgacctgaatacactgtcagccctctccaaagggtttgggcccagttagagcagtgaaactcagttcagcacatgtttgttgaacatttactgtgtgctccacactctccttggtcttttttaataaattctttttgtctttgaagagttaatctggttacagatatgaattgtaccctggtgggagcataccagaaaagagaataataatgtaaatgctagactatttggatgagattttaagtctgtggaaattcagaacaaggaaacacaaagacatgaattcatttttttaaaaaagtctctgagcatgtgagcagcacttcttccttttgaacatggatggaccatttgcagttgcattcagtattacgagcctcctttgtgtccctccccgtcatttttactacattcaagaaacataacaataaataacaataagcctgtattactcactttaggttatttggttaaggagaagcttgaatatggaagtttgttggtttttgtctccaaaatgcatttagggttccccagcattccactttatcacattcaaaataattgggtaagtaggaaaagatataagcaaaatgtgtatgttaaaacactcttcttatatgttctgttcaacaccaaccactagaaaaatgtcacataatttccacagttaagtctatcccaacttgagccttaatttttggtggtagcagctgctattttgcgacaaaggtaaactcttggtgccaaaatttccaagaatgtttaggatgcatatgatttttggccactctggagaattttgaacgtagatggcaatgctgtctgaaaaatggatccctgtgaaagaagcataaagygtgaaatcacrtttaattagccaagagtggctagtgtatgttgccattaaatcctttaaattacagcacatctgggcaccgtccatcccacaagaatgtatccaatgatgcctctgtcttacctgtgagtccagcttattttctcctaacttctcattactttttaactattcagtattcttggcataagaaatcaagaaaacacaagatgcttccatgtttctcaataaattattcaaaatgttataccaacccttccccacccccaaaatggcaaaatgcccataagaaagtatttcaattccctatttggaaggagcttttcaagacatcctcttttacttcacattttaaaattagaattctatagcatctgtcaatttggagagggaagaaaacacttataatttttacaaacatcacaagagtctaagttgtattagacttgatggcattcaggcaagcaaagatcaaatattcagccaaatagtctctctgctaatgataatgacatataaacccttttatggtgacatgggttgggtcttctactggcagaggaagtgtatctttatgcgatgagttctcactcttaaatacaaggggagtgctggtttttaaaacatgaggctttgagactgtagtacacagtttgctggagatgtgtttgggtgattgcgctactggggaaaatgcactgaaaataggtcatcaagaaaagattgatatagacttttttgtgtggaagtaattatgcttgattattgcagtctgttacaattcaatatgccagactatgaagtttcagtgagaaaatattaatatgtgcacatataatcctacctgggatctgtagactggagtttaaattcctactgattaatcctcacaggktctttatctggtattcagtaataaagaatggaaagttttttatatatcatatatgttcttgttcattcacttaaaaatcccaaacacatacgttagttcatcaaaaacacagctgaaacattccactctattaaatgtaacacacacacacacacacacacacacacacagccgtaaaaataacaacaaacccatctactatcagagtaggaaatcttcaccagcctactttcttgccaagatatatactgttcaataaacactttataattattacttatttgacataaattattgcctaaggccaatgttaagagactttttgcaagtttatagcaatgactgttgaaatgatttaaggaatcggattcttaggactttccttttacataatgtatttctgtaattctcagaaggcaattctacaactgactttaataacaaaacacaatacaggtatgccagggtccccatccatggaaacctttgagaaaataatgaacaaaattttatgttttttctactcatcaggggaaaggacctataggttcttttgagttttgatgtcatgtgatactcttaccagggcatgcaaagtgcttcaaaacctgaactcaagctacctgtccagctttacttgaatctccacacgtgtgctccttccctttggctcaatcttttcctcgtcttggggtggatttgggccccatgcattcctgttgtcttttactttgtctgtgctaacacatcattgtccccttccacaggaagggaaacatcatctcacccatgatggcacagcactcacattgcgtgtctgttgtttccatgactgtatcttcaaggagtctggtctcctcatgggatatagccactgggctctaaagacttcttgctcatatagtaggtgctcagtaaatatttgtggcataaatgagtgagtgaaattacttcaaaagtgatcacttgaaaaatagaaaatacaatcatttctgcctaatcaaatgttaaacgttgctaccacctcaactaattctgtacccccatttggcagagtaagcaactcgagatcacatttgcagcatttggaattagaattcarttcaccctcaaattcactcaatctctcttaatttttttattttaaaaaaaggtaaacagaaagtaggtcaatcaaatcacattctcattttaacaggtccaagagtctatatagattttgaactgaattggcacacaatcatggacaacttcctaagggcttttactcatggcattcagagttttaagaaagaaaattaagtgattggaatagagtacaatagtgaatgcagaaaaagggaagaaagatgactgtagccagaaacacgagagaaagagaactataagtttctttattctaagtagcggtgggagaatctactttttggcctgcacagcggatgcaccatttctatgggtaagttttccctgtgtttcctgtcaagccggggttttaatgaaacaaaaagataccggatccctctcgctaacacctcttcatccccccaacaccccagctagtgccagccaagagcatttctctcagttccttttatccctttctaccaagaacaagatctgagatatgtgagatcctgtttgattcaagcttggagaaagcactgtatattttacagccattggttacctgttgctgtcaatagctgtattgtcagcattttatcatggattgaatgctttaaaatttttgagcagcataaaagatttgtagrggaaaacctattttccttagaaacragagacagtgttttttgatgcttcaaagtcttaaaaaatgtaggaatattagagttatgccttgccctgcttggtgggttttgagtgacattctgagaccatacattttgtgtcaagaatcgaatcaatttctcttctttgggctgctgacattgtttagagtatagatgaagactccccagtaagacatgtaaaacagtaagggactgtgaaaaaaatagattgtgaaaaataaaagtctatcaagatggggcaaacgtttaggggaatactatcaaaggtagtgttatgttcaataaaagatggctgaaatasttatgagactaatagacaaatggaaattatttacacaaacttctgtaactgcccagttctgtgaaaaacaataggaaaatcgaattcagaaaacacttatccctgtcagaattagaattaggataatggatccaccaaaatatgtgattgcttacactgaaagaatagccattatttttaacttagggtgaatttgactaatattgaataataggtgatttaagaaattattttgaaatgtttgttttaatatgccaggacaaaatgtaattgttataatttaagaaatacataattaagagaaaacaacacatctgaggaaagtaattacagtgctcagaygttaattaagagacactaaaaaacagactacttgttgaaatagtgatgtttgatagaatattagctatgttattaaaagcttaaaatccattattttattacataatagctaaaagcagcaatatttggtctaatgaagaattggcaaatagctataaggaatgattaaggcttctgcaggacttaatttggataaatcaggttttaaaacacaattatatagggaatgaattaaattattgaagttttaaaattatgagcacagaaaggaattatataggtttaaaattaatttttaagaatgaatactttcatcccactttcaaaaggctttattttttaaaaaaagtatttaaaatgaggcctgagtcaaacatttcagtatgagaagccttgcacaaaatttagctattgtagttatggtcctttggagacggtattagtcataaaactatgtatggtctttgtattaggataaatttactttggcttctgaagtttttgataaggatatatcttctgtrcaaaagcagaaagggctgtaaaatactagagaatgtagacaaaggtaccataaattactttggaaggacttcttgccatcctgaagcaaggttttstgtgaatgtttacagctgactgtcacatctttagttacaaaattcaattttgttgcattatatccattcataattgaaacattggtgttttatttcaaattactagcttagcatatgataagttaatcagcaaatgtggttaaaataataggtgtttcttaacatgctattatttctaccattagagaaaaataaaacaaaaccaaaaactcctctcttgacttcttccacatttctccccttccattgcctgctaaacttttgggaagagttttctatagtcactatctattttctctcctgtcctttgctcctgaactcagtttaaaaagggttctgctcccaccattccaaaacaaaaaaaaataccttatcagtctcaccagtgcctttgacgttggtacatccaatattcagtgttcttggtcctcactttatggacctaccaagagctttcaattgttatcattgtgtcattctggagatgctttgttcacctgacttccgggatgccatacttgtctggctttcctgccatctcactagccacatacattgtactccactgtcttcctcaatctctttttctagttccttctcatccccccaacttctaaacattgtagtcctkagagttcttccttgggctacttctgttttgcatctacactatttgcatgactatctcatccctgtattctctacattgataactcccaaatttgtctttctagaccagaagttgtacctgaaccccagtgtcatatattcaactatccatttagatatgtaacacagttctcaaacttgacatgttcaaacttgatctcctgatcttcctcccatcccaactcctacttccactgtcttctttatcccaataaataacaactgcactcagttgtttaggacaaaaaccttggagccacttttaattcttccatctctcttacagcctacacataatcttccattgcaaatgtcagtattgctcctgggttacattttttcatgatctccatccaytgctaccacctatccacacttgcatcatgtcttcttgggttatttcactggcttcccagctggtctccctacttyaccatacaaatcagccagggtgattttgttcaaatgtaagtcagattatgtcactctccaatttcttgtttaactcagaataaaagccaaaatctctactcatgaagtgtccatcaagccccaaatgctctggcctcctattatttctctttttatttttttaaaaaattactttattattatttagagacaggtctccctctgtcacccaggctggagtgcagtggtatgatcagagctcactgtagccctgaccttctaagctgaagcaatcctcctacctcrgcctcctgagtaactgggactacaggcatgtgctaccatgcctggctattttttttttcttcaaatttattgtagagacggaatttatctatgttgtctgggctagtcttgacttcctggactcaagtgaacctcctgcctcagcctcccaaagttttgggattaaaaacttgagccaccatgcttagctctcctgttacttcttcagtgacctcccactccactctcccctcactcccctcttctggcctcactgtcctcctagcctttctggatcaccaaggcacattcttttcaacgcctttgttgttgctgttctctccatttggaatgcctttcttttataattatttatgatccacttcctcacttcctttggtttttgttcaatgatactttttcatttgaggacttccctggacacactgcagtgatattgcaaccacctctcttctcaaatgtcctctgtcttcccctctttatttttctccttagttcttatcactcatgcatttttctaaattattttattctctatctcttcccattggaatgtaagccccttgaaggtttttgtgtttgttcaccatggagccccagaccctagcataatgcctggtatatgataggtgcttagtaaatatttgttgaataaaacaacctcttttttttttttttttttttttttttttttagtttgattttgcttgaatcctattttggctgatatcactgcttctttttttagcttgtattgccatatataacttgcattgtcattttatttttgacattttatgcaactttttattaatgttaaatgaaccttgcaaacatcatataatcacattttttgaccttgtctgaaatcttagtttactttttcaacattctttcttcatcttgtttgatttttcatatttatccatactaattgtgttacatactctccagtttttgctttctgcactgtctggtctttgcatttatcgtttctaggtcacatttttaattattctagacattaactagtaaaatgccttaagttttttttctgtcattgtcaaaagtgaagctgttttctgagtcctgcactacagcagagaagaaatgcattaccacccaccaccagcagctttcttccagctccctctaacttctctgtcactgtcatttagtaatgtaaatacaaatttgttattttaaataaagaatgttcttaagtttttttgttttttacattttctttggatagtcatacagcagccagcctaacaaaaattatttgtattttttatgtcttagcgcttatagtttgttgctttataccataattttagcatttggggttgggctgttccttgaagcaattgtttgaagtgttgttagataacttgttttctgtgtaagacatatatgttatgtcttttttctcttcacatgtgcaagacaacctggatgcaaataaaattatttggttacaacsttttttcttacaaaacatatggtccctgcttttttatgttatggcatttagtgttactgagaaaagaacggaaagttccacctcaaggtcacttcttttatgccagatttggcatatttgatggctgcaagaggaggtggggtggtgggataggaaatcttcaaaacttagtacctgcctggtaaaaggaagagacacagaactctgactagttgaggtattagaccataagagtattttaattttctctccatcaacaaaataattaaatatattaaaatttatgtatttgaatctttaatatttaacaagattattcacaagtattaaatttggcttttcagtttcaccatttaaagggcaaaatcattctgcctgatatatcttagagttcttcaagcatctcatatatatatatatatatatatatatatgtaatgtttatataaatgtcttgcagtgactcttaagaaaataatcagttctccataataaggcagttaggatttacctgaaaataaagataatatatcaagacttagcaatatgctagcttttcaaccaaatatatcattttctgcatggtagtgggtatctttgtttttttgaaaaatatttttgtgattagaaaattatacacaatcattgcaaatattcagaaataacaaaatatataaaataaaatttatccacaattccatcagagatacaaatttttaacattttatttaacttctttcctggcatttttctacatgcacatatatacacacagagaggcaggaaggagggagggggagagagaggaagagagaggtgtacatttttaacaatgattgccctatacaaatggcttggtgatctgccttttgaatctaaaatatactgaaactttgtcatgtcgttaaacatcatttttagtcactgtatcagttagaatatagtttgattgcatgcccaaaaaaaccccaaatggctgtgtggttcaaacaagaatagatttgtttctcttttcttttccttgtcagtccagactggtggacctctcttttacaaagtcagtcaagatggtttgcaccgtggtgtcgacatccaatgttcttttatcttgctccactgtcttggaagtattactctcttccatatttcctggttagttcacaatcctgtcagtattctgtcaaatgaaatggagaaatggagaaatggcaaagcctgtgtattccctttacagatacaatgcagaaattgcactcttcagtttgccagaacttagccgcaagtccacaaagaagactggaaaatttagcatttattctggatggccaggtgctcaggtaaacaatttgtgactgtagaaaaagggggaaatggttattggggagcaattggcaatcactgtcaaactagtatttcattaaaatatgttttgacaggtttttttctgttattcaccatgcattcatgaatattcttacatttggttcccctgtaacaacttcttaatgatagccaagatttcctaaatatttatagggttccagatagtattttaattatcttgtatgtattttttcaactgaatataatgatattattaggtagctacacttctttatcctccttcagggatatgactgaggaagtctagacttataataggttaaatgagaaagtgttgaacaacccgatcgtgtgcacaggrctagtaaatggttgattgacatgagactcagatctatgtctgaattccaagtccttaactcctactatctaatcattttttagaaaaaatttttcgaaggataagttctgccacaaagttaggcatatttctaagactgttgattcacattgtcaaactgcactctgaaaagcaggtgccagttggtgctcctgtcagcagtatacggaaggacccctttgccaaaacccttcccagcattaaatgcttaacataccaaaagaacagaaacaccactctaatacaycactaactaatacattagttgacatttatttgatgaataatatggttgaacatttacattggtatttattattgtttccatttcttttgtgaactgctttttgtacaaatcttttgtttaaattgtgcttttttttattatttgagaagggatctgcctctgtcactcaggctggagtgcagtggcataatcttggctcaccacaacctccacctcccgggctcaagtgatcctcccacctcagcctcctgtttagctgggactacaggcacgcacttccatgcccggctaatttttgtattttttgtagagacacgattttgctatgttgcgtaggctcacctcaaactcctgagatcaagcaatctgcccacttgggcctcccaaaatgttggcattgcaggtgtgagccaccacacctggtcctaaattgccttttatcccattcaatcattgctcttttgcttatagattattagaattctttgtcttaaggatatgtagtttggattccccctgacatttccttggattttgatagactttattggatttgggggaaggtgtattatgttcattgtctttgtcatatataattttttagataattttgggatttataactatggaagtggatagattttaaaagtgaaagatacgctaaatgtcatcatagttagttcttacttgagagtatcaccttaattttaaaaatgataatccctctcttagaagagaagacagaaggaaaatgtgtcctctgaaggcttttatttgcataaattgtttatatcttttgatcaacaatctttagctattttgatatccaaatgctttaaaagggtatattatttctttctcttctaaaacagaggatgtgcccctggtttttggagcccataaaaataggcattggcctgaaagtctggctgtgaccctaatgagaaaaatagctatgacctgtctctcctgtctgttctcttctagtactgtttcccctaccctctttaagtcttgcaggtgtaggataatcatacttatttctcttttttgggagctagattattgaattgtaggcttttaagaaataaggggacttccaggaagttgatastgttgggtagaattgatctcataagctaattagaatttttgcagcccatttgcaacaaaaatagcaatgccctttttcttagatttttattaagagagatgtaaaataatattttaaaggaaatgtgaactacaggagaaagtaaagattttgtttattacaagttgtaaaggcttagtttataaattattttattgtaaacattgctacaattttatgaatcttctagtgttacacactagaaataaagatctctcattcgtaaaggatcatatgagagtcttcaagacgactcagattggccttatgaggaaaggatataaaaggcgttggcagcctacagtctgtacactaaaccggttaggaaaataattgtcagtgaaatgcaaaagaccagatccttcagatattaggcagttctcaaagaaataaaagtttggcttagcatcttccctcttccttgatgtattcttctcctatcctccccagatacatattatttygttgcacttggaaggttagaatccccctttctgccccttgtctgggtcctccttctcgccaagtgttaccaggctccctagtcattctgcctattttcccaatcaaatatccatttctatgagtattcatttatagatatattcactgattatctgatcaacgtaatttatgctggactttgaatttccaaccttcataaggacatatgtacatttttaaaaaggaacrcattaacagcaatgattctgtaattgatatagwgtagatgttttaaaattttattgtgataaaaacacataacttgaaatctaccttcttaaatttttaagtgtacagtatagaattgttaattatatgcacgttgtacaggatctaactagaatgtcttaatcttgtataactgaaactctatatccattgaacaacttctcatttttccctctccaccagccttggaagctaccattctattttctgtgtctaagagtttgcctactttagatactacagcattattcacaatagctgagagatggaaacaacctaaatgtccattaatggatgaatggacacagaaaatttggtatatgtatcaataaaatattaatcacccttgaaaaacggaagaaaacccgtcatatgctacaacatagatgaaccttaagaacagtatgcccatcctggctaacatggtgaaaccccgcctctactaaaaatacaaaaaattagccgggtgtggtggtgggtgcctgtagtcccagctactggggaggctgaggcaggagaatggcgtgaacccaggaggcggagcttgcaatgagccaagatcgcgccactgcactctagcctgggtgacagggtgagactctgcctcaaataaaaaaaaaaaaagaaacaagaacattatgctaagtaaaataagccagtcacagaaaaataaatactgtatgattccacttgtatagattagatgtttttgagggcttggggtgagatatttctggggtgagatatttttcattgctccgtgcttatggctttaatctatttttccctcaattggcaatttgccttaatctctaaattgtcagtgggtgtatttgataatgaacatttcttgtacaaagaaagagactagcttggtttgtattgtccttattaataataaccatttctcaagacaatcatagtaccagacactttgtatttgtgttctcatataatctttataatgcaatgatagacactattgttgtttttcttgttattattggtcttttagcttccttaaagtcataagtggaaggtaacagaacttggacttgaacccaggtctactgatttcaaagcctctgcttttaacctcatacccttcagtgataacgggctttactcataataatggtggagatacagtttgaaataggtttgacatagatttagcgtacacattcctaagaactagtctctatggaaaaaaaaatgtaacatgacttcttcaaagccagaatctcaagttttttacattgatactgtgggttcgaggctttctgctgccatggtgctttcagagtatggacatttgttcttgtttttctaccttgttttatacattcctctatccccacagcccagcaatgcacgatgctatctggttggttagtctgcactctctgtcactgcccatcttaatatacatatttcaccaaaatccctccttctgctagctagaagatcttgttcactttctccactaagagggaaacctgacccgtggtcttcctgccaatctcacagcattactctacccaaaactatgcacagcagctttctctccctcctttccaaggttgcatgtagtgaatatatttacggctccatgggcagagtgagtgatcaagaaacactaagtgattgtggtggccagaaatgcagaggacatcatggtatatataaggcaaaattatccattgatgacttattacttatttggccattcaactagagtttttaagcactgattcttttccctaaaaccttattatatcataatggatccgttagataatctagtttaaattaaaagaaggaaaaaagaactttgccctcaggaaggaggaaaataacatcctaccaaatgtagaatgtaccacttcggtggtacatttaaatactacagtagcagaaaatgatacctgataatgtatatagagagctatcagtcctctcggtgcaaaaacaaaacagtaaaccatgtaagtacttagagacattcaggaatatgtgcagctctcataagtttcatcctactcactgaattcacttcagagaagatttcttttaattgtagaataatgtgatgggtttttttttttcatgttctatgaatgattctatgctgtggaacagccttcaatggagaaattcagaagaagcaggatgtgatgttttcacaatccaaaaatgctgttgttgcatacactccagaaagcggctctgctgttaaaggaatttcttggaaatcttttatctgctgttttgaatagctgtaatataaatgtaatagatattgtctccattgtattcaaattgtattttctagagaatgagaagatggagtctgatgtcagccttcattttttttaatatactgtttttcttccctgccagaataatgccaacttcatgtatgttgtctacacttccttcacgtagatgagggaattatcttgaatatgtttcttttgaggaaattgagaagtctgctcagggagtactactgaatgctttgcttgctaacctatacatcagaacaaggtggtatatctgctgctctaagaataagtacattttgctacaaagagaagtatttcatatacttacttaaaatctaccaaaaagttcagggaagctcttagtaagtagctgaggttacttagcttcaggggaaaaaagctagaacagagtgtgtgttcaagaagtaaaatagggcatggaatcactaatggtggcagtgcatgaggaattgatatgagatgagactacagaaataactcagcaagtccagtgtaaacttttatttattcatatataaagcctgatattattgctgtaatttaaagtatattgctataatttagataaaatttttccatcactgctttcttttccatctctcagctggtcttattattcaagtcccaggacagtaaacattttgtagtttcaaaagcccttcagtactaatggatttttttttaaaactagttgttttaaatgaaactgtaattatgagaacatatctctcttttcttccttttggcaaattccactaggcattaaagcttattacccagttcaaatcgattatatttattttcattcatgactcacaacgtttctaccttctaatacttgcaagtatattcatatgtgatttcaagatctctcaagtacattttctgtatctttcctgctttgtcatatttgtaatattttatatgtaacataaaatatatggaagataaattctgctaactataaaagttcatatttttttaagttatcagaagttttgttctatatatctttgaagttactgaaagctcagatttcatttgaacagaatggtattgtagggacattatctagtttctttcaggctatctctctcctgagaaagcttgagtcctggagctctttggaattacagctgagcacagagaagatgggaacttgggacaggtgaatacccatgccctagacctggggaaaggaccagatctgattggaagaccctatagctctgtgcaagtcagactggggctatggagcagccttcaactggaggttgacagatcccttgagagagtattacatggtgttcacgtattcagagttccttttatggactattggagaccaagcttgaggccttggacaagagagagtttttaaagtacagggaaactctagcaatagtatttatgcttaggaactagttctctaatagcagtgaccactgtttccagtggctaaacctaggggcctgcaaagctattggaayggacacagatcagttttctgaagaaaattctggcccagtcaatagatactctcatggctgaagcctgagcagatgtgagagggtcaattactgagacagaacagggcacgagaataggtattgaaacctgagagacaggttgagagcctgtatttggatttcagagtgcagaggtcaagtttgggagctggaagaaggaagaaacatgaccagggagaaggtaagcagaaggggtgaactgaaactagatgctgaagacacraggtcataaacgtgaacaaggatcaaagccctggcaactcaagaaaactgctcaacccaggagaggccgctcaccctttacaacagaatacaaactttgccttgtctctgatacctttctgtctgtcccaggaaggtcactccttttgtgaaatcacgctgttttgatgtgcctcttctatttattggattggatcccattgatggtttagaacccattctatggtaattgtttatacatttctcttcccattctactccatgaagtcctcagcaccagagactaacttaccacatgayatgtaaatgatgtacaattggcaaagagatcttgagagtctctgtatctgtttgtagggggaacccaccaacaaacagctttgatatagtggttcatctctaggatatagataagggtaagtcatgctgcccaatttattcagacgcctcttcctgcctggctctaaatctttgcagtaggagaatgacataggaccataaggacgtacctgaagccagaatatgtttatgtattcttttaataggcactgtaaaaggcactgtgatcagtgtttgggatgcaaaataaaacaatgaaatctctaccttcaaagtctaataataagtatgatgaccactgtttcttgtacatgaacgatgtgccaatcactgctgttttccatttatcatgtagttcaacataacaaccctgtaagacttattatatccattttacaaatgaaataaggcatagggaggtcatataacttgttcaatatcatgtagctgctaagtaggtgagcttggattagtgtgtctgaattcaaagaaaaagaattttagtagtatatgtcctgatctatgtaccccrttttctgtttctgatatttaacaccatgaatgcccttagattctgagtgattctttgttgagaatgaaagtagtaacagagagcaatgttataaaaagccccttccataattcaagcaaaaacattatgcatgccagtaatttcattttcgtcttcacaacctactcaaagtgagaaaacagagctaaaaatagggatgaggcaatgttatgtaaagttcaggaaaaatgtaataaaagccagatttaggtaaatattattgcagaaaagatgtattttgttaaaatggccttaaaatcttttctgtatgtttgtttcaagatataaaatatagatcactttttaaagaaatgattcagtgactattacacaattacagagttaccaaaaatgtcttcactgttagtatattctaaaatttgatgaagtattacacaagtcaaatcagaatttatttataattaatctcttgatattttattacagattagtgtttttagaatgtaacaattacttggcctttgatgctatttactgaaataatttttctaggagttatttcataaacgcctatcagagtgtagaagattattttattatcctgaataaagttttattttgtttttaaatgacacataacaattgtacatatttatgggctacaatatgatgtttcaatacgtatatacgttgtataatgatcatatcagggtacttagcatacccaccacctcaaacacttttcattcctttgtggcaaaaacattaaaaattccctattctagctaatttgaagaatacaatacattattgttggctatagtcaccctactgtgcagtagaacaccaggatttatttgtcctatctgactgtaactttgtacctgttggccaatccctctccattcccgactgtccccgctactctcacsagcaggtagtcactcttctactctctacttctatgagatcaatgtttttaggttccaacatgtaagtgagagcatgtggcatttgtctttctgtgcctggcttatttcacttaacataatatcctctaggtttatccatgttgtcacaatcacagtatttcattcttttatggttgatgttctgtgatgtatatataccacattttaaaattcatttatccattgatggacacttagattgattccatatctaggcaactgtgaatagtgctgcaataataggagtgcagatatatctttgacatattgattacatttcctttggattacatttcctttggatatatacccagcagtgcaatggttgacacatgtggtagttctaattttaattttttgaggaacatcatgctttcttccaaaatggctatactagtttacattcccattgacagggaataagagttctcctttctttatatcctcaccagcatttgttattttttgtctttttgataatagccatcctaactgagatgagatgaaatctcattgtggttttgatttgtatttctctgataagtagtcatgttagcatttttttcacttacctatctgccatttgtatgtcttcttttgagaaatatctattcagatctttgtctgttttttaatcaaatgattattattactattatttttactgctgagttgtttgagttcctgaactttcttttacctattacaatccagtgtcaagaagatagtgtattaatttctttgtttastttattgatcaatgtttattgataatatctgccttcatgcctacaatgaagcaaaaccttataatactgctttctgtatttcttcaagattccatagccatgcagtgtaatgttgaaaaatcagcagatttactttttgatgtaggagaaagaaaaaaaaaataaacagagataacagctgtctaccacaaatttcctattttgaaagttctatatatttgtttaatatggaacatttacatgtcatgcactgggctgactgctgggaatatagaggagaacaagrctgtccagtccgttgcttgcatagaatactgctgttgcacttagtactagagcaataccaattatgatagcatcacttaattaaggttgggcaactgtgttattatagttaggtaccatgtaacattgtgatttttaaaatgaatttatctcatttgataaaaatgcatatttttttctggcaggtatgaatttgctagaaattctctagttagactgtatcaactacagtatcatttattcacttaaaaagctgttgtcatgttcattatttgtacaatgaaaaaatgggagagatgcattttattgcaggcttctactgttgktaaagcactagatttttccactttgaattgttcaaaattattagtttatcaaacaaattgaaagaaaagccagggttctgttgctaacttttgaatgaaattttaagcattaaggcacatcaaatcaatggaatataaatatgaagatttttattttttacccagccattgtatccaaccaggctagggtgaattctacttttctatcctgcaatggcattctttgtgctttcggctcactttggtttttaaaagtccatttctttctaaaagattaatctccaggtcaattcaaacttcaccttttactcatcccttagctcgagtcctaaagcaagaagaagagagttaatcctagtaagcctcttattgttgctcattttttggttgagaaatgaagaaagatatggcacatagtatacattctctaaatatcaaatgaaagcatgaatgaacaaaatagcagaataaattaaattcagtgatttgctaaaagttaatctgaaatgtatgcaggattctgttccagtctttaaatctcacacacacacacacacacacacacacacacacaatagtaggtgtttagacgataataaaatttgaacaaaaagttcaaattacagtggaagactgcctttgaatataagttactttttttctgtgttagtctgtgaaataagtaagtattgaaaccttccctgatagatctccaaataatttcccattctggttggttggacatgtgcttagcaagagtgcatgcacctccagttcctccaagtaggggaaaacagaatggggagacaagggagattgagccgtttttcaagtatctcactcaggaggctggctgccaatcaaggacaccccagaaggaagacagtgaagggcacatcactggtgaggaggactaagatggatcgcagatggcagcctggaaccaggcctcccatatcagggagctgtgcagtgggggtgctcacagcctcactcaaagaaagcagacataggcccccaaagatattcaccttgtggaccagaatcttcctgttctggtttcatgttcttaaatgatcataattactataacaattattttgagtttttaatttttgatcttttttgttttaacacagtaagtaatctcaacattttttgccatattcatgaagcaggaaatgtactttaattccttatttataaaaatgttatggaccttataatcagaagagactcagatggtcttatttagtaagatttgaaaggatagattccggggtttctagaatttaaataataacttctgttgttacttctgtagtttccagagttttattgtttggttccaaaaaataaggagaacttgacttagcatagaaaacataacctttcatgtcagctctactttaataaatgcaagcacaattttgttcagctacctagaaaaataatgatattaggtaatctacaatcttttagcttttacatgaacctaagaattaaagctgggtctttaacttgagtttggtagatttaaagtaattacgtttttgctgtctacgaaagttgtttagttaaagatattgtaaatgaactataattatgtagatttacgtctgcttttaaaacacttgtgctctttcactgatttgaaccttcrtatatgctttcatatttattttgccaaagaaactatagataatttgattccatagcaggatgttgaggaagactttttctcttgccttggaatcactgctattggtccttgggagaacacaatgatgtctaagaattccatgttttatagcaaaccaccaaccatagtaaaaggtagcaccttttccaggtcttactaaaagaacagatcctactactgtcaacttttaccccagcatccctcacacctctccctaggccttatgagaagagtcgtggacaaaggagacgaggagagtcatcaaggacagctgcttcacacaatgctttggtaaagggtcttgtccccagtttcccacttcagcttcaacaaggccatgcagatatgaaattggagcatgagcatgagaatcattcagaaagatctaaaatatctgcaacaagtggaaattgacatctatagggagattcaaatctaagattttgttgaaagttaatctgaagtacatgtaacacttaacagtgatttctgcacccggccgaattctgggttctattctttacacacacacacacacacacacacacaaatggtgggcatctgtgctttaaaggtgaaagaaaaagaagggtctgtgatataaattcaaatttagacctgctgtaaaaatacagtatcttttctgtatggttgggccgcaagtaaatctggaagcatttttttgatagatcacctggtcattttaccacttgctctttcttttacagttttgctcaatcaccctgttggtatccctttcctgggtttttggcataatttacaagaggcactgatgatagtgagtacaagtaggtttatttctatttcaactgcctccactaaacaaagggcaaaaaaaccttgactgcatgagagattgcttctcaaataaaagctgtggttttctgtgtatatggtaatactcttaccttccctgtaatgtttcagtggtactttttttctaggaaactggagaacttaattttatacaggaatctctggtcttagaacttagcctagtggtaacagttttaaaaggtctctacctccatttaaaggaagcaattattccaaaagcacaggatctctggttgactaaagactgtatcaaggatgaaagattatgtctggaatatttcctgccttatgaacttttgtgttcaaaatataaattttagatttaaggaggcatgtgggtgtgtattgctcactctctgatatacaacatggttattttatgtttggtagtagtagttaaaataaaactatattarttgccttcttactaatgtactaaaggctaaatgaaagaaatttttcatcaaatgttataaattttgtttgattgtatcaatttgagatacggttcagtattttagaaccaatgtcttaaggtaggcttccatagttscaattaagcttcataagaaatataattaagttgaagcttggcattgtttggtaggtgtctggctggcaccacgttttccaaaaataagatttgtttgaaggggcttgggtttttcccttaatttcaaggttatgtcttggatggggcttgggaaagggcagtgggttctgactacacgtcaaagatgttaaagacattcactggcttgacatcatgtggacagtggcttgcttattcttcgtttcctagtatcaattaaaataataaatggtcaggttttgctcacactatttttaaaatgaagtttatgatccataattttgtgaaataaacttgagttgtattcagtacacatatggaatagtaagttattacattttaaagatgacagtgatgtaatggtatacttatatattatrtttgcagatagatttttcacagaacaagattcctcggttttaattctacaatgtgatattggaattaaaaacaagtctcttatgtgtgaatattttatctctatttgttattatcaaaataaacactattcatagagttcaatttcatcaataattaataatgtgactaatgcatgataaaaagaataagttaaattatgttttttgcttacaaatatcacattaattgaataactggagtaatattatgctgcttttattaaatatgtagtgacaagtctagaaaataaactgattggcacatttgttaaaatccatgttagttttcctgaagaactacacaccctaataaataacttacttatgttcaaaatgarttaaatgtggcaaataattccaagacatttattttacctaattatatgtggttgaacaactaggaacaaatattttacaagtgaaaaccataagacacatttttttaggacatatgtatatactaatgctttttaccatttattatttgctgatagtccaggaccatatattaaagagtgatttcagtatccatctaaattttcatatggtttcatttaatcataggattaagagaatattttaaatgattagaaaatatcctcaattttttcaaggtttagagtatttatatttatacgttaaaatctttggaaaggcctaaactcagggtgttttgaaattatgtaaattaatatatttaggatctaatttattttatatctacattagcttttccatgtataagtttcacaaataaataaacttcacaaataaaattaataaaagctaattaaaaatatcaaacacctttctttttcaaatgtgtaatttaatgagattctgaattaccttgattatttctaaaagttactattttttcaaatgaaaataaaacttagccaccatttgaaggctatatgctcttagcttaaactgatacacttgcaaatatagctatccaactgcaaaataataatcaaatttagatattcagactctgagtagagaatggaagaagttgtttggctgatgtgaaaattgaaccaatgattttaattttgaacatactaagctctaaccaaatgtgtcaagtgttgccaaataaatatagaggaagaggataccatgttttatattaagaagggttaatcatttgtctgtagaataatttctcttcaaggtgccagtgaaatgtattagtgatggttagttaactataacctgaccacatagttaccttatatggtcaggttatacaacaggtcacctgttgtcaactccatatctttctagttccaccactcctgtagcagctatatgcattgtaagtagcagattttataaaatgtgtagatcaatccctttggaaaagaatatcaactatacatcatctgtatttcttaattttatcctattttttctctttcttttaagaatactaatgtatccaacttttatattcctttttgtttgtgttatattttagtttctgcataagatttgttttttacctagcctttctaatggggtttcagatgttcatactccagtcttacaggtcctctcctctagaatggtatcttttacgtctgtaatgttctctttatttccattaccctttaattacaagtaaccatacttcaagtaagcagcttttaaaaattaaaaacttgaataaattgctattcaaaatgggttattgaataattttaatctaaaaatgttttcaataagtacatttcaggctagaataacattactaatgacactttattaatagtgctactcatctttctgggataaatgtgagatactcttggataaggaatgggaaagtccaaatatagttttgtatatggaaatatatataaaatatatagtgtggaattttttattgaatattcattggtgcctgaatatctcatgggaattcatttaggatttgcagaatatttagcagacatgttagactttagtattgtcacattttggattatttctgattattcgatgtattagatatatgtgctaatgtaattttggaatcaatttgcttgctctcttctaccttcaaattaaacttaaaattagagtataatggcacaacacaatacatgccttaaaaaactggaggacaaagttatttttagcctagaattgtgaagatagaacaagacaatctaaaaacttttatcttgtgactcttttttcagaagctgctggagtatatgctccagtgctcaccaaaataagggaataaaccaataaaggggattcatgggattcaggaaaccagagttgcagccagtgaaacagcaatcaraatgacctgagcacacaagctaggcagagcctgctgccctcagtccaactggaacgagttccagtccaactggaatgagaggatttcggggaggaaagtggaaattctatattacttattcattgactgcatcagacaatatattaatccatatgtgttttgaaaatctagaagtgttttacagatttggagaaaattagcaattggtcctgagaaaataatcaaatttaaaagaccttaattaactgcaagaaaaagtcgagtagaaagtataatcataatacactactttgctcaacagtcatgaatatttacataatgataacgttgaatacctctaaaatatgatatttatactctaggtttggagagaatagaactatttaagttagcataaatacttatacatgaaagtaaaaaggtaatatatagtatctaaaatttagaagtcaaraattacaataagagtatgttatctgaaaatatggagttaaattacagaagagatagctgaaagaattgaaaatgtgacctgtgggacactggactggagaggtggagtgaaatgaagcagggtacagctgctttccattatgagtctggcagtagtccttgaagttttaaactacatgcatgtctaacaaaaaagtaaatatttttaaaagggcaaaaaatactgtgataactcttgacagtttgcaatgtagaaaagaatggaagaggctgtcttcatcttttgaagctcatttcctggtaatctcccctgcctgctctcagcttcagccattctggcctttttgctgtttttccaacacrtggggcttggtcttgtcttaggaactctgcgcctgtgccagcactgctcttccctcaggtgtctgcagacttcttcgctgatctctttcaaggctttgcttgaatgtcacttctcagcaaggttccccttgaccactcagtctaaaattgcacctgctcatgcatctgccttattccgctctaatgcttttctccatagtgtttatcaccttcttaaatactgcatgattaagtcatttattatggtttttgttaactttctatctccccttgctacaatgtgaactacacaaggacaacatgtttgtggtttggatggctggggggtccaccagtgcatctcaagtgcctatatatatatatgaaacatatatatggaacactttttattttaatgagctattcagtatttcagtaagctattaaatggtgcttggcatacagtatgtaatcagtatatattagttgaaggtatcaattaactaaatgaagaaagaaaagactaaaaaaggaagggaagaaaaaagagaaggtgggacaaaacaagggacacaagttaggaggcaaatgcattatttcataagatggtggtggtttgagtttgggtagaggcacgataaatggagagaagtgaatgaatttgaaataggcttgaacataaatttggcattataatgaaaaatatgattatttctaaaaccaatgtttcatctgttttataagcaggaaatacctgaaaataaggaatgtcaagattctagtatatgttattagaagtgaatggcattcatagtcatggaaaataawgttaaattattaaatgctatttaaagccacagaagttctagacatcgaataaaaataagaatgatacaataacttagctaatgacaacaataaaagcttttgtagagttttcctacaagttttacagtttagcttgcctgtaagttacaaatacgaggatttttgtgctttgaactataaaagctcatacctaagagtaatgaaaggtttaatattgtacttatttaatagtgctttcttctattaaaaacatagtattctattcttatttataattttatggaaaccaatttcactaacatttataaagtttgatttgaaaataaattatatttcttaataattatatgcacagttatgacctgcatggatttaagctttcgcataatttaaaaatccatatcttcattttgactgtatatttgaaaatactgatgacagagtaatctgattgcactgtaactggccatttttgtgaaataaagtccttttttcttgtctcagtagtcataactagttacgtgtatattgtggttttcttccatataaatgtttctagattgcgtacatttaaaataacttttcatgtctaattctgatgcacatctttagcaaatatgaacagcaaccttgccactgtctctgattsttaacttcttccttctcttatcctttccttatcttatcttctttccttttcttatcctttcagagcctcttccttttctgaaacttagatgggagataggaaggtatggttgtaaaagcattacatctgtcatatgatctatcacatatcatataagaaaatgcattatattttggaaactttaattttatacacatatatatgaaatatgttcatatgaaatacatttcactttattaagctattcaatatctcaataagctattcaatattacaggcacctagataactaaaggtcagtcattacatttatttcagtgtaagaacttaacggggaaaaatttaagttctgttaatgagtttctaataaaagtagacctgttttgaaaacagaagtgtctgtttccttgttatatttgaaataaaaaattatgatgaagcattttccagtgtatgaaactaagattcttttatccataagggactaatgtgtagttgaagatgtccgtaattgaacagcaggaagtattagataaattcaagaaagcccagtaaatcctagagggaattagaaataaagttcatatatttattgttaactgcaaccattttatatgaaaattataacaaggcaaagcttacatttcattatcaatatagtgtccctatccactgttctttgatagcagtcaagtatgggaaacaatataagagatggttatgaagttgataacgtgtttagcactgstttgtactcattctgtatccaggaatctctttttattcattgtgttaaatattcatgagcacttaytctgtgtctgatactatgatgtagaggatcgaagagtgtactagtttctgctcttaaagtaatccataggcagaagagagacatacaggtgtatgttcattgaaatatgacagctaccatttgaaaaatgyatggaaatatagatgcttagtgcatttggtaaagaagcrggtgagactaagggaaggggaatttttagggtagcagtgcttaagtatgttacaggggcttaaaagaacagttcagtgaaggagagattgaagtccagaaaatcctggagaaggtaggaggatgggaaaagagtggtggcatctgtctctatgagatacaatgagaaagacgatgatgaaaatagaacttagttaaaaggtgaagaggagggaacttgcaaaatttcccgttttctgttttcttggtgagaacagaatgttcagtctgctcctgatcataaaaggaaggatttagcagtcactgatctgaaaaaggttggggaacagagacgggtaaatgaattatgggtgtcagggaacattcctctaagattataaatcctaaatttgtcatttattcatgtaatgaatatttacagagcacgtttgcctaggttaggtgttgaatatgcagcagggagcaagataggcacattttgaattcttaagcagttcatgccttcatgacacagtaaacaaatattaaaaaattattactcaattataattgtgagaaagaccgtaaaagttaaagaaatggtattaagataccatatgatgcatgagaaggcttgggattgggtgaggaggcagagaaaggagaaagtagagatacccagttggagaaatggctgagcaaaggccctgagaccaggtgcttgagggaggcaaggcttcccactcagtgtgctctggtgccactcgtgaattacacgtgtgtcaaatattcatccgctcagctcttatgtgttattccaaggcacaaagaacattatcactttctaactgagccataatatgaaatagtttgagaagctttgcattaggggaagtgacctcagaaagktttcatctgtagcaccagcaaggtgcatggaataaataaaatatctggatgttttattaatttggcccttcttgtgtgtttatagtcattgaattaattggtttattcagcaaataggtagttgataaaatgacactgcatttaacctggctagttttataaatattacaaattgacacagagacggtccacaatatggaagtttatcttggggttttttatgaaaagatttaaaaaattatcttaccttagcaggtatgggggaaagttttctctcatttcttttccattgagtattgtcagtaaaatagaataagattgagtgaaatttcaaattatttaatgttcaaccaaaagaattctcaacttattcacacatatatattaagtaaagaattcagaaaatcattaataaagttcagacaaaaaccgtctaacctaattcccgggaaaaaaactggaactctgcctagaattatccagctacacagtctgtattcattttttaattgcataccttatcctttttatctctgtgtatagcacctatttaaaagaaacagaaacctggcctggtgtggtggctcatgcctctgatcccagcacttttggaggccgaggcgagcagatcccttgaacccaggagttcaagagcagcctgggcaacatggtgaaaccctgtctctaaataaataygtaaaagaaagaaacagaaaccagacatttctgtttttagctgtgggttgctacacctctgtgaaatcataggtgtttaccactgtcttaaatcactggtttatgattacttgatattttctggatttttaaaacattacttctttttttaagtggtgtagaagtaacgttttagcatactataaatttctggtaataatttgtattacaaaggtgcatattgtttaaggtcccaagtaagctttatgtatagaaaaggttcctctgctctttctttttgtcctcaaacgtaaacttctggagacctggagagaatgaaaggcgtccgagtgtgtgtccatggcaatccgctagctgtgtggaggaagttacagtggcattaagccatgaaaaggatcaattgtttttgtgaaaaatccttgggacgtgccttgaatttaaagaatcaagttcattaaaatcataaatcatctattaatcttattttgttgaaatatccttggtggtccatggtattttaaagaccaaaattgtaaaaaatgtagttaaagtaacaacataatgggattgttgaggacygtgaaataatatcctcaatgccttttcttcttgagggtttttactggatacttgctctacctatacctctcctaactacagaactgaacatgatgtgagatgtgtaactttcatttattcactcatgtgccaggcaccatgctgacattacatgtgaaaagtttccaaggttttcttgttacgtctacaattactgctaagtttcccgtaagtaatttgggggactggaaacgagggcaaaattacatgaagggcttagaaaactgcatcaattctttttggatgtgtcagggagatgggggtagtctttctccctgctaatcaagacccactagagcaccgccgtatactgcacacatacttctgaatgacaggagctttgtgtgagatgagaaagctgtgtcaggctgatggtattatcatgattccttggaatggatcaccatcccaaatcaccagacactccctgatcagsagggaacagcacattctccagctactgtattatttgggaggttcaggtaggaagtgagtgcatagcctcaaggggtctggtggaggtcctcttgggaaatgcagaacttctttgcctactaatgccccttgctctgagaccggagaggcttctgggaattttatcctcacaagaaacattcatttcatttaaatagtatgtgaagcaagacatttaagttagttagargtgcatatcatttaaaatggcaggagatgacagtttctgcaagccatttctgaagttaaaaaacaaggtagtttaaaataaattgtatttcagcagtcactattttcttaatttrccaatgaacttgaatgacatattaaagaactttaggcattatactctggtttgtgatccgcttgaacacaaaatgcatattatgtgatcttatttccaaggttaaatcagtgtatccttggctagatctataatagcttatcagataaacatcttctgtcaaaataatatttgccattaatgaaattaatggcagaagtataaacttcagaaagatatgatcacttagatgctaaaaaatctattaaggaaaacaggttacatttcaatatctttgtctttgtgttctatgatatgtaaattccaaggtgtaaatcctttcataaaaacatttttttctttttcctagacttagagagaaacattgacttgcccacagagctagctcctttgatgtgcaataatgctacctgtggtctgttttaagatgctcttttttggccaggcgcagtggctcatgcctgtaatcccagcactttgggaggccraggcgggcagatcatgaagtcaagagattgagaccatcctggccaacatggtaaaaccccgtctctactaaaaatacaaaaattaactgggcgtcatggtgtgcgcctataatcccagctacttggaaatccgaggcaggagaatcacttgaacctgggagccggaggttgcagtgagccgagatcgtgccactgcactcctgactggcgacagagtgggactccatctcaaaaaaaaaaaaaaaaaagttcatttttatttaaccgttaccattatcacattagacagtgcaggagtatgttaattatctctaggtgtcccagtggcctagtaagtccagggcaaaatgccagcagagtcctggccaaaaacactacattaacttgttcagtctcttgacatcctcacaaacagaacagtaaacctggagagaaaacatgtttgttccaaatgagttaactattccaaaataaataatatctaacccctggccaagaatttgtaattgtgtataaaaagtaactaatgggatgtattctccaagactattaattatgtactgaacaggaatgctttttaaatgttgttcctctgagtgcaataaacctgtgtaatctaggctacctaatgagcatctttgagcatctgccactgcagagtrcattcaaatttcaggcaaaatttgggaaatgctgttgcagcagtggcccagtaagacccagtgctgtcattggtcaagataggtcaccaattacaagacttgaagataagcatgttgtgattggtggttgaagtgaatcccctctccttaaggcctcactttggggattcacagaatgggcattgtggaggccccaagttccatggagaatgcaactattaaattgagaaagaaaagaaagtacaagtgagatgttaggcaaagagtagaggcatgagatggggactaaaagtatccagcagaggaatgtgaagccactaaaatgattctgctagccagctagaccgtacttaagctgtactaattgagacaataggatttgcacagtttccgctcacttcaaataaactgtacaatacaaggaaataaaatgataactagtaattatcacttcatagtctactggcaatgaaagatttttatgtaccgataaagcagtagatgtaatcttttttgtacagttatgagcaaaatcagtgatgaatatagctaggtgctcgttaacaatgaaaagcctactaattagagatgtcatcaaagtgtttaatttttttaaattgctagtggggaaatggttcacccttgaatatcaggatttgtattttcaatgtgcagtgagtgtccatacttacccttaaaactaaagagcacttcagactaagaatcagatagcatcagaaaacaagtgaataatttatgaccaaaaaaacatgcagggcacattagataaatgtcacattgctgttgcatttaaaacgaaattgcttcactattgaaagaaaaaacccaaatgcctgaaaaataaaattcaggaaatgataattgtcgttataagcacattttttacaaagagttcaaaatggttttacacatgccctatctcttgttacggtattattgtaagtaaacaggagtttacttacagtaaaaatatatatccctatttttaaattgtggaaatacaagcaaagagatgtgacttgtccaaggtcatcacttaaaggcagaatgtaagattccgatcttaaaaataaagtgaaaagaggcataaaaaaatatgtgtttatagttaaaattagtcagatctcccttgctcatcctggtttctttttgtaatattgcccaagcttaagtagttttaatgagcaatagcaagtggcttataaaagatactggcaaattgaaaatgtcttaaatcattgaagatccattgaaaaattatsaatttattatagtaaatrtgcttcttgggaataaaggtttcttatttctagaccggctaaaaaaaamaaaaaaaggaattcatgccaaaaatgaattttcagtcaatatactgggaaaggagtcaagaaactctgccttgtccagacataagtgcacagtgaatcagtcagcatcctgacagcaacttaacatgacccgcacctattttagaacaggttgttaacacataaagctgccagattgtcctgcttaatggatagacagtgacatttgggtttaattttatctaagcaaaatgtgctgttttagaaataagataaaaattaaaataagactatttcaaggtttacccacaaaatgcagacccagtgcatctgatcatcatggccaataagatgatctgtgagtttgttgcgtttcctgttttgctatggttcttgtttttcattatcttggtagctgaagtacttaacttgcctactatgtgtcaacttggctattatttcataagcttaactttaaaatgctgttaatgctgcatctatcatgcagtctcttggaagaagattttaaaatggatttcaaatgtttctttacagtcttaaaacatatttacaatctatctttaatttatctagttgtagaatcagatacattctttcagacattctttaaagtgcatagacactttaaattttttgaatatttaacaaaaactcatcaaatatttggaaaacctgaaaacatatgaaaaaataaaaatcactcccaatggcaccacataaatttacatttctgtatatatgtactatttataaaatagtatcataactgttgatattttatatcatgtatatttcaaaaaaaaatcaataaatatatttgaaaatatacttataatggcttcacgtcatttcatattaggaaccttatataatttatttaaacttccccactttttgtatattaacatattttatagttattcaacattttttcaatgttgtaaacatcttggtacatcatgttaatctctgttaatcttttaaaatatgttctttggaatagaattattgtgtccaagatatgaagagttttaaggatcttgataacccttgtcaactcacttcccagaaagtttatagtagttcattcttctacctgtatataaagaaacatatcaagatttctggatcatcattgaatatttaaaaagtaataataaacctttgacaactggttagctggaaaactgctatcttcacattattttagtttctgtttctttgacaccagtaaagtctcacagttctttataaatttattaattgtatttgcattcttaaaacttctgtgctcatattttgcccttattgatttgtgataattttgtatgtgtggaatatattgtaatatttgtttaatgtattttaacatttatcaatagcttaattttacaatttgtatttcattatacatttctctatacaagttttaaatgctatataatcaaagctataaatgtttcttcataatatccttttcttcatacatagaaatgcatcccccatcttatgattaatttaatgttcactttgtaaatagtttttatgcatctttttaaaaacattctttattccacttgtaatttatttttatgtatgtgtcaagtacaatttaatttttttcacaaatagtgttcccaacctttgaaccttcatacttttccttatctaattgtgatgtttcctttaacatatattaaatttgcatctatagtargttctatgttagtgctgtttgcttttttctattgatctgtctatcaattcatttttttagtaattgattaaccaagcctttattaattcacacttcttctaaatgttctagtcaatttttactctccatttattattctatataaattttcaaaaaaattctccagttagaaacatcccagtgagatytgacctattcattaatatggaaaaaaaaatcacaacttccccaaattcactgtttccattgaagaatgtagtagatctcttcatttattcacattttcttttatattaaaaatagttcatatctttgttcctttatgaacttgcttggtgttttgtgcttttcacggtaaatgtgaatggaatcccattgtatcctctaattggttatttgagtgtgccagttgtccagaacttcctgagtgaccccaatcagaaaggggcacagcagatgttcttgctctgcgtcagctttcagtgaaagtacgtgggcataagatttcaaaacagcaatcttatcattgctaaataatactattatggtaagataagttagtagcatataataacataatacataaatataataacacattatttttgtcatttgatgaattgtgtttkctactcccttttatatactttttcttacacagattgggttttcttctcacttctaatattatttttagctcgttcctttaattgttatttgtatatacgttgatatttttgtctctgttcctattatcactgagcagtcaacattgggtttttctcttatgatggaacaaattcactgttatagacataaaactaggtaactataatgattgtagtacaataacaatgagtttgtgcttagtgttttgttgaaattatagaaggttgacaggaaaaaaatgtggtacttcatccacagattttattttatacctgaagctcaagtaaagctagtttaatagaagctatcctcatgcatatygtttaagctcaagaaataaatcttctgacattgtcaacttttaattttagcacccaaaaagtagagaatgctttaagtgaactgttatgatgctgtaaaataatatttattaaattgagaatatgtcagtgattcattatcatgtaaagaaataggttaccaaacagtgtcattgaatttaagtaaagtccaaatttattatatataaatatataacatctagagaaacatacatgcatgggcaaaactgttaatagcagttatttgtagggcataggattacaagtgatttttaaagtatttttgcctacctgtattttttctaatttatttgaaataggcatgcattattatgtcataaagatcaaaattattaatatgttttaacaaaaaataactcaactttagaaagatagataaattacattagcttaaatgcatctaagtataggaaaatatactaactacttatcaagattagcctgtgaatattttgagctttcattgaaaagtttgaatagtaaacaaattaccaacatagaaattctctctctgaaagcatgtccagtgtctaagaaacataaaatctaattgctcacctttgagactctccttggtcctgtgagacatatgcatttaattggatgtctcactaccaaaataagcatatgtaagaaatgactccctttgttcttttccattatccttatgttcaaactttccatctccttgaatgattttaccattttgattatatagtgcctcaggcatctactttttatctctttaaacttattcttaaataaagaggttacctggactcttataactcatatttttccagaattacctctttttaatgatatgaattaaaatatcctcttattttgcataaagtttctatttaagttttgagacattcaaaagtacttttattttgaagcctttgaagagaggaggaaaccaaaactctgcttcctaacactggaaggtagttgaaattggaaaacaaatggcttgatatatatactataaaaagtggtattttttaggtcttttggttacacctgaagtggttaacagtaagtgcaatgtttgagctagtattatagcctaaacaaaccatactatctgaattaccataattagctaaattaggtttcataaatgtcgttgcatgtatactgaataaaagtttaaattccagatgggtaaagataggctgtatgataatttaacttcacagcaagccaatccttaacattgaatgacaggaagatccacagagaaaatttgccatgtataattttgtagactctgtactcgtgggcaaatttaattttacttggaaagtttgtcttagcaaatcaaggttttgggttagatcatttggrtcataaactcagctttcttatcaaatggagaaagacaacaaaaatagaacatctgaagatacaaagtatttaataaccaggtgatgtgttcataggtgttctttaatcaaaagttgattctggctgggcacggtggctcatgcctgtaatcccaacattttgggatgccaaggcgggcagatcacttgaggtcagatattcgagaccagcctggccaacatggtgaaaccctgtctctactaaaaataaaaaaattagctgggcatggtagtgcatgcctgtaatcccagctactcgggaggctgaggcagaaggattgcttgaacccagggcgtaggcgtggggtgaggtgcagaggttgcagtaagccaagatcatgccactgcattccagcctgggtgacagagcgggactccgcctcaaaaaaaaaagttgattcttttcttaaaggaattcctattttttattttattctcagagaaaagacttattttgtttccagtgacagatgattgtgactgctgtcactatcaaccgttgtttatcaatgccacttcagtcttaagcatgtcttgcttcaaattctttggtggatgataaccactctgatgacagtatactatctccagagggttctaagtccttcttcaagccttcacaaactacctatatttcttcacaagcacacatccaaccctttcatttcagttaaaatattttttggattatttcatactcttctttgaaatttttcctcaaaatatatgcaacatatgaaatacattcaatgccattcagtcaactcagtagactacctcctcacttttaaaagaaatctaggtaagaagagagagtaggatgaaagttaaaagtgtgaagatggatagtgatctgtcaccaaaaataagttcctagtsatctatgaagatcctacatgagcgctccctggactgtcaaatcttgagttctgtgatttctcacctcttgatcctcatgccttttcttctacctggaacattcagtcccttttctcaggtctcttctttgtcagtcttcttcaaggtctttaatggttcatctctaattctatcatttctttgccacatttctagacttctgctatcaactgatctcctttttatgtcctcggatattctttagtaacttctttaaaggacgtgaaatatgcaagaagtatcatctaccttgaacaaattcactttaagagatatggaatcctagaattcaaacttagatctgtggttattttctatctgaaagttatttttcttaggagcactgtatttctccctattacagtaatattttggccacttatggcaataacgtgtgtatgtgtttgtgtgtgtattttgtcagagcactgctgctagaatttttagtagaatgcagttgataaattgttaatcaatatgaaacagagactttctttagggtaagrccacaatcagaagcatttttagaattcaaaatatttataatgattttttttagtagaaaatcagcaccctgattttaacttggtgggggggtggtaaaaattttgagaaaaattggtttccttgatagggagttatcaaggaaaacaaaactttgatttcctttacataagtgtaaacagaaatgaagaaatatgtctttataatacatatactaaataaatatatgtatttttatatatgcttgtatacatacctgtttgcatatttgtaagtgctygaggtaagttcaaggtggaatgggttgaaaggagaatgtttaggttatctgaaataatataaaccaaattcctctcaatttagttaggaggttagaaagctacttcatgaagaatatttttgggacaaattttaaggtaaccttaaaaaagatttgctaatatgtattttcttgtatatcatgtgaacaatcacttcctgaaatttcttagttttatcactacaaaatagtcacaccataaccgccttgtcaaagattttaaatggaaagaaacaaaatataaaaactacaaagaaactgaaatccacagaaacagaaaaaaaattctatatttcattattttaatggatcctaaaatgcgtaagcactttgatagattcttttttatataggatttcctggttttcaaagtatataatgcaacaaaaaagtgaacccagcttctttttttcttgttcattggagctatcacatctcatctatcagacctctaagtagaatttttaaagtggggtactctctcacgcccaagcactatgtaattagcatatgaatgtgtaacggattgtttgaagtaacaattaagggaacaatacataaaggaactgaagagagctaccaacacctgggaatcttgtattgaaaaagctttcttaatgtaagtaattaaaaaccaaggataaatgttcattgtgtagggataaaactctacaaggaaagctaaaattctgctgatgttttgctgttatcctttagaaggaatcattaaaacaagagcttacttttttatttatttcaataaaatgcttgttaaatacaggttttgcatggtatctgatctcctgaagtcaccacaatgcataacaaaaatgtcttacatttctaaaatattcatatttaaaatgtatataaaatgtcaaggaatcttcttcctatggccagtgcagtttcagagaaaatttcaattgattgccaggttaaatcacgtatatagtcaattctttataatttatttgtccaagtaattcctgctaatgaatctgtagcscgctctrttgttttgcactattttgtgtctcttgaaggcaagcatgctatagaggctcctgctgaggcggagcaccttaggagagtaaccagtagctcaggattcttaggaatcgttgatattgagggaggataaatgaagtggaaggcagggaccccgcattatggtttccattttttatcacttgctgcctgtacaaaccacttatgttttttggcataaatcttcttatctctaaaataagaattacttttttctagactgttaagtctcagtcagtaaccttttatggccctttctaatatccagttgtatatattcatttgtaataaagaaactcttaaccccggaatttaacttaaatcagtttagtcttaaataactagcattttatggaacaaccatatttgaaaaataaattgtgagcctaagatttcatttgtaagtagaaagtgaaacaaaaatgtatgaatattcataacagcattgttcataatagccaaaaattagaaacaacacaagtgtctattacttgatgaatggatgaataaaatatggtatattcaattgtcaaaacaaaaattgcaccaaagttaaacaggaaggaaatactttactcaaggctgttgcagtaggggagagaagctggatccgagtctgaactcaacacacatgaagcaaactgggtcaggtttttaagtgctggagtgagcttgtggaaaagaactgcaggacattcagggccataagctatctgtatttgctgattggctttatctaaactacctcttgtcataaagatatgagtttatctaaataaatttaagtttatctaaataaatctaaataaattcatatctttatgacaagaagtagcttttacaacttggagcaaggtgccccactgaagttaggctcctaccctcccacctaaactggaagataaaggtgctgtctctcttgttgattacttttcaaagaggtagttcccaggtccttgagaggtacatttctggattataaagttaccaagtggctaytaaaaagatttacgcctcacaggagtagagaaagaattacaagccgggcacagtggctcacgcctgtaattccagcactttgggaggccaaggcgggcggatcacgaggtctggagttcgagaccagcctgaccaacatagtgaaaccccgtctctactaaaaattcaaaaaaattagccaggcgtggtggcatgckcctgtaatcgcagttactcaggaggctgaggcagaagaatcgcttgaaccggagaggtggaggttgcagtgagctgagatcatgccattgcactccagcctgggctacagagcaagattctgtcaaaaaaaaaaaaaaaaggattacaattacaatattcttaaagtaaattctataataaagggaaatcaagggcctatggtcaagaacaaccctttctaaagtttagtcaaaccaaggggaactttcaggctgtcctggtcaccatatgatagaatattcttggacagtgaaggaggatgatgtattgatacatgctatgccatgtataaacctcaaaagcattatgtgacgtgaaagaaggtggtcgcaaaaggccatgtattgtatcattctgtttatatggaaatgtctagaatagtcaaatctatatagtcaaaaatattagtgttttcctagggctgggggatgggcgtgggtgtggggtggcagctaagggtatggaatttctttttagagtgatgaaaatgttctaaaattgtttgcaggaatgattacaaaacttcgtaaatattctaaaagccattgacttgtacactttaatggatgaattgtgtgatacgtagattatattttaataaaactattgtaaaatatagatttatgttgaaatgtcttatatagccaatagaatatttacttaatatatagatttttacaaatttaaacacaaccaaaacctttatttttccaaagtacgttttggctttggataacctgtgaattttaagtgtgcatttctgatagctggcctgccttttagtttttataaaatagtaacttattaccatgttgtaataatcagatagtatataacatgaaagaaagaaaaataaattctgaaatgtccttgagatatttgcatccaatagagaaaacaaatgtataaagagaataagaagtaatttcatactatataaacagagtgccaatgtatgaatgaataatgttctacaagtacatttgtaaactagctatttgtagctttctctrcagaaacagttctgccatccgcaatcaggttccaaacctatcctgcaaagatttattttacccacartgtagctgaaatgaagtattaatgttagtacagtcagggattaagggacaatcatacaggaaggaggagaatgaatctgaacactcccatttattggaagcaggcatggctcctggcaaaattttgaattatgcagagtgagactggttttcacccatcttcttttgtctatcccttgccccatgttctagatctagagactctctctgggtcatggggcattgactatttttatggccctaagtttcccattgcattacctaactcaagcatctctgttcctccaagtgacaaattcactcacgctatctgacgtaacatttctccgaaacaacatatgaacatttaaattctactttctgaccgcagctaattttgttttgcattaggaaggaagcaaattttgaaagcgtgataaactctgggtacactagaagcattttcagataaaacttggattgtaaacataaaggtatctttaattaataagatttcaggcattagacttagggaatggtaacaaaaatttggaggcatgacaagctgtcctttctgactccagtccctctttggggctgaacccctctaagctgctctttcattacctaaatatgtactttgtttctgcctgaatgtcagcatcctttaaacacaccctctaaaatttgcactagctaccagaactagggcattggagtgtataatataatggtggtggttgaggttgagagaacacattgagaagatgacatggaaaggagtaatcaagaactatttatggtatgaataatttgggcatcttttatttttggacatatatttttctacatactgattacttggtttttcttttttatagattgggctaatggatactacagacaacagagaaaacttgttgaagagattggctggtcctatacaggtaaacatattacttatataatgagatttagcagaaacttttattgttttgtatctatttttatatataaaaggaagctttgtagcacaacacatcatgtcaacttagctaaatggatagttagattaattaatagatatataaaatataaaacgatatcttatgggctttccataaacaaatttggtaatgtagggcttattgacatccacccaaactgtatttgaagctcaggcccaagctgtctatataccttcaagaaataacataacctggggctctgtttttttcaacggtgaaatrgggggctgttctgagcattaaatgagataaataaagtgtgaagcacttgtcacagagcctgcttctaaacagaaagctctcaacaaatgttagctgctggagttgttatgatcatgctaatgattatttttgttcatttaacaaatattgatgggattcttgctctcagaaggggcattcttctgaattactgttgttaatttattggtgttagagtaaaaaatgattttgtcacattactagactttgcctagaacattatgaacatctgaagttggcttgaaatagttacaaccaaaaatcatcagcagaaactctgggagagaaagttctagccctgagtggaagaatatgagtggaatttgggtgaaccatgacatgcctagtaaccatgtgggatggagttgagcattagagttgggtactcattagcagtaaacttgggttgataagataaagtcagattacaagggctttaccatgagcctggccaattttacttaatagatgaagtgcagaagcatgctgaattttgtagataaggatgtattttctttcttctttttaattgctattttaaaagtagtaaatattcattgtagaaaatttagaaataggttcaagtacaaagaaaaacataaaatcattattttatttccctcaggaatagccacttaaaaaactgctatagtccttttagacagtttttattatccaaaatttatatattttatttatagagttatgcatgcagtttactcttaaaattatatttatttcctcattttaatattcctgctgatcatgatagttaatctgcttactaatccattgaataatttttttattatgtaaccacttccttatttttgtatatttaagcttctataagcaatgacagatgaattgacagatagatgtgtttttatttttattacttctgtgctatagaattattgatatgcaattaccgagtaggaaaaaaaaaaaaaaactttcaagccaggtgtggtggctcaagcctgtaatcccagcactttgggaggctgaggtgggtagatcacaaggtcaggagttcgagatcagcctggccaacatggtgaaaacccatctctactaaaaatacaaaaaaattagccaggcatgttggcgcatgcttctaatcccagctacttaggaggctgaggcaggagaattgcttgaacccaggaggcggaggttgcagtgagccgagatcacgccactgcactccagcctgggtgacagagcaagactccatctcaaaaaaaaaataaaaataaaaaataaataaataaataaataaataaatagatttgtgatgcacactgcctaaatgcttcctagatgggttacactcatctgtcatataaatgrctaccccactgtatactacccaagattgatgattgtcatattgaaaatctttatgaattcaacagatttttaaaaatcatgttttgttactttaatttgctttttttttattaccactgaagtcatgattttaattttttattagccatttgcactatacctcttcagtgcaataagttaaattagaacctggaaaacaatcaagatgtttatcagagcaggaagagtgaacaaattaaggcacatctcgactgtggagtactctgcagatgggtatgaggtagacctctgtaatattgtacagaaagacctactattaatttactcatttataataaggacccatacatctataaaatactacttttgatattttaaatcctaaaaaatacataaaagcaaaaattattcataatttgactccattttgaattaaatggaattttcttttttatttttctatgtaaacaaattatacccaatttaataaacatcagcaaactctatttacttgaggaatttcttttttcagaaaacatgaagtttaatcaaaaaggttgttggaccaaagggcctacctatttataatattaacagatatgttcaaattaatttcagaaaattgtgttaaaattatctatttccccacattttcactaacactgactctaaaaatctagtcaatttgattagtcaaaaatggagtctaaattttaatttgtatttccctgattacctacaaatttttctattatgtttttgtatgtactaccaattgggtatatgtttattaaataatgtagtattgtcttttaaaaaactttataattttatatactttataactttacatctgacaattgtaactcattttgtcttcttttcctacgaaagagaaatcctagtattttataaaaatcatgactgttttttaatgcccctaataattatgagaaacatgtcaggagggactaagaatgcttagagtgcatccctaaccatggaagatgacattacaaggtgaaatccttagttttcctggaaaatatctgccagtgtcaccatctgggcaatatttaatgcaggacatctttttaaatgattcatttaaatattgctagttgtggtttcggaatgctacttccaggataagcttttccccaagaggttctttatgagtattaaagttctacatgtttgggccttttatgtttatatttttatttttaattcctaagaatatcacaagccatcttttaaaaattcactattgtgttgtttttaagataatgtttgctccattaagagtaatatataactgctttaaaaacgtgatacatagagatgttatcacagaataaaagtcagcctggtttagttttgtyaacagctaactttctagtttcagaagtgaaactagaaggaggtwattttcctctaaccaatcaattttcaaacagagaactcagatatttaccaagtatgtatgagtaaaatgaaaaacaaactttaatgcaccctccactctccctaaacccagagttagaaaacagaggacctactgcctagggaataagaaaattatagttctcagctccaagcaagggtggatgtatgttgactaatggagtgatggtggtgtgtgtttcccagcagcccagggaccctatgcatcttsggtgtgcctcmtaaggtcaggagaagacaacagttttaccagggtttcagcagatatgatagcaacagcacataccattgtgcaatatcttattatcttaggaggcaaccacagagctgctccttttaatgggctgagtatagacacagcacctatagagtggctaggctttgacagatgggtctttgaagaaacaatgtgtagttctttgctttaaaatcaagttgaatcatcttgctcataacctaaggcctattggctttagcttctttcaggaaagtctagtgatcaaagggatagactcattaaagcgtggtatttgttgtaggggggtggggtggcagatctcaaaaagggatgttccagagtcagggtgaggatggaagcttaccaaagttttttaaagagtgaattgctttatttatattagtgcttcccattggtttggaaaattattcctagaatatttgaggatcctaggaagaaactaaagatgagtacattttacaacccttcgtttagctcaaaactgagatgacataattattttgtctgaattactagactatcaaagagaaaacaaataaatgaaattctttatccaaataaatgtatttcacccaagcaaattacattaaaaccaaacctttaacgtggattattcactataaagtgaattatcactttttatttttaatacaaatatttaaagtttggtagtattttttaatttctatgctatttttccatttagaaaatgaacgactatgctaactgcttgaaataactgtatgaaaataatgaaatgttagtcttatcattcttaaatgtaactaattttgtgaatggcttgaggaaattggacttgaccacattcagttctagtttcaccttaacagtttatcttgttgagctgtatgtttgtattccttcccatattgtctcatcatttaaatttatcaaattagtggcaatcacggaagaaatggcttgcccttgagtgtctgaacatataggattctattaataaaaattactaagtacattataaggcttgtctgyaaaagaactaataagccatttagaaatattacattacacatcaaacattatttaaatgcaatcacttgagctaaagtaattatgaaaaaaattacacaattatgatatatgaagtaacaatgtaaatccccgctggctaccagatgggtggagaaagggaggagaggtaatactcttttagttgtgttttatgcataggttaagaaaaactttctattcaggatgtatgctacaattatgctaagaaatgacagggttggtaaatacagttgacagtcccatttttaaaagttaatataggaggttgagcaaggcttgcttgtcactttgtgatgaaagagtgaattgtaaatctgggaatgtcagcactaagaatctgactctttctgtaacaacttcatttcatttaagggtttcagaaaataaatgtcactcttcctagtaaccttaagttttctatgacaattcctaaacaaagacagttcagtgaaaaaaaaaaaaaaagataaagtgaagtcattttattttttttaatctcatgaacacatagcccaagattatcctaggagatgttaaaaatcttcttttcgagttgttagatctttgattgcaacctcaagcaatgataagatcatcagaaatgggagtactttaactgctttattcttagaagtagtacgacagaaatataatctttattttctggactttaaaaatattatattatttctttttcaccaatctttaaagcagcttgaaattgaaaattttatattgatatgttctcaggtattcttaaaaccttaacacctttaaaattttagttaaagaatgcattcgattcaaataagaaagtatggctgttctggtcacacacaagtctgttatacctcgctggatatgctagaatgagagagtctttaaataycgaattgattctatttctgtaaatagaatatcctgtctaaatagtctttccattttgataactgtatgtagaaaatgctacttatagaaaacaaaaaggccataatttaaggttgtgtatagtatagtttggtgtttggcttttatttttggtttagtgttttatttcttttggcccaggagaaagtaagccaaattttactcagaaagaaaatttgaatccatgtagaataatgacggatttttggcctttctttaacttctataatctagaatatccttttaacatattatattttcctctttgattcaccacttcttatataaacagactgttcctttctaatttccaattgagcagtagaaaagagagttccagaactctaactatagaattatctcatttctgttaaaaaatatgtatttatatggacatagatgaaaggctggaatgatatatactctaccctgttgaccatggttacccctggagagtgagtctctagatgtggatgaaaccataggaggcaggagcttcacttctcactgtatactattcatactggaggaaaaaataatttttgacaaatatgttgacacaaaatattttcaacttaacgtgaaytaattttagcaagaagggcaaaggtagttggacaagaaccgtagcttcgtgtagtcacctgtcaaaatgtagggcctctgcttggctgaatctcagtgagaggatatcacagaccctaacaagagcatggacagtgctcagtgcaggttttctgatcatcattaacctacagactgactaggctgcttaagagctctgcatttcgagcttgcagtgagccgagatcgcgccactgcactctagcctgggcaacaaagcgagactccgtctcaaaaaaaaaaaaaaaaaaaaaaaaagctctgcatttcgattttcccgtttgtaaaatacttcttaataatgcccaacttaattgtgtgcagatcaaatagatgcttcacattgttgcagaaaagctctttgagcaagtacattatgaatccaagtaattattattgaacagtgtcttaacttgatsccaaacagattgaacaagcctgggcccatccrataatctcacaagaggatttagaagtggttgatttgcttgaatggatattatagacagatatttcctatcatctgtagattttttttaaagyttagctaagatttatattctggtcaaactttttctatgctagataatggtgactaaagcaagcctcgttgtggaggctgaacagggttcagttaagtgatctgaaactcagaacctatgtgtattgactctattcatgaaaattgctaagagtagattttaggtgttctcaccacacacacacaaaacagataaggatgtgaggtaacgtatatttgaattagctcaatttagtcattccaccgtgtatccatatttcacaaccacatgtgtatacaataaatatatacaatgtgtgtttgttgatcaaaagataaataaatatgcttaacaattttatttggtcgcaactcttatgtagtatggacttaaaaaaattaagatgtggctacagaatagcatcgcaattagataatcattgtttattttctctgctagtaaaactaaatgctaatgtgtctcccctattaaaaaaaaagttaaaattgcatagattctttmctgagtccagcttcacaagtatcattgctggtagcatctagtagaagcttcaatgggatgggcaagtcctagcagctcagaatgaggaaacttggccccttcttcttctgtctgagctggaactgtctgggctttgtgtrggacgcattgtgcttcttccccttgctgggcctcctttacttcaatctctgtggtttttgtttgttygtttgttcgtttgtttttgtttttgytttttggggttttttttgtttgtttgtttgtttgtttgtttgtttgttttgagaaggagtgtctcactcagtcgcccaggctggagtgcagtggygcaatctcggcttgctgctgcaatctccgcctcccaggttcaagtgattctcctgcctcagcctcctgagtagctgggactacaggcgcccgccaccacatcccggctaattttttgtatttttagtagagatggggtttcaccgtgttagccaggatggtctcaatctcctgacctcgtgatctgcccacctcagcctccccaagtgctgggattacaggtatgagccacctcgcagagcctactctctgtgttctttactcagtagggctctagttcgtgaaatagacacatttcataaaagaaaaagggaagagaaaattacatggctaattaaaagaaatctaagtctaggctgcagtttgyattgtcacacaaaattcacttaaatgtgttacacttttaggcaaaatgccattataataattttatgttgacctgtgttgccctccaatttcatgyatcagtaagggcctagtggaaggcttatttagtttcaatttcctttgttttctgtatggtaattctgactctttaaaccaagaattttcaaggagcaaaaagataaaaaatcattatcaaggagcaaaaagatagaaaaatcatttctattattcagacaaatttttattaagtgaagcatattttaatgactgaggcacagamtcacaaaaattattttgaaatatagtgagacacattttgacttagggattttatttcctttatcccttaggaggaatgtrtatatggctgtttatcctgttatctgtgaataccatgtgacaactaaagaataaaaatatcaaactwttaaagaattaaagttagttttattccraagcctgactgaggactatagactgaggcctatagccgggagcrctgctgctgcacactgttgcagccacggcttttacacaggttgtggaggttcagtatgtgcaaaatcacatcagattcactyaaaagttacgttaaagtagaaacacatcgaggtttgggtgtgagagtctatctaactacagatgactaaagtacattggttatagattacagaagcataaacactaaccccatcagatgttatcttatctgtaagaaaaggcaaagattggggtcatttgtcttctagggaatacagtgacttaggcaagagacgtgggggctttgtgctgtatcctcttttgtcttcaaagcctccctccagagagttgcacattgtcgcagagtcaggagcttgtgaaattacagtggcaaacagaaacgagcaaacatgccttcctacatttaccactttgtctcatacctttttctgcttaagccacatagtgttttgttcagatgagataaccgcttgactgaaccagagctgggccttctcttggctggatgcagaggatcttggagatcgtctgtggcccttactacaccagcatccaaactgttatagactgttatagagcttctaactaccacagaatattctggtatgcttacaacagctgcacgtattcattcttcaattgcataattgtgcaattgcacaattgcacaagtttctttggaagagagggaaacttgaaccctattgagaggtagggtccagaccagaagagccgtgtttgataacctcaggacagtgggcctgttggaagccagaatcaagggagaggcaaggaggagcccctgagagacaggagacagttgggggactgaggaagaaatatggcagcagagactgagggcagagtggagcctggcaccaggaggagcaggttcccagttcattgtgatgcacctggyggctcccctggggccttccccacccagagtgttcctctttctcaaatgcctacatgctttgtcctggaaacaacagagccccagcaactccatagtggggctccytctgaaagaggcagaaatgagaagaggaagatgctgggggttcagcagccgaggtgcatgtggtgcaggcattcagtccaattaaacaggcacccagagtcagggtggagactgatggtctggaggaagaagcagcaaccttcaacaaaatcagattctggtccatgcaagctaaacttcattcccttaggggatgctattcagctccctaatttagtagaataacttctgatgaccaataaaaaggagcctatatacacacaggctgaggagacttagtgtgataagatggtagatgccttctgatcggattccattaatgccgagatccttaaagtgtagagatctgagccattatcttcacaagtattgtaagtgccaatctgatatttttttcccacaaggaaaacacttttttatttatcattataaaagtgtgttcatctaagaaaatcatgtatgtatcatatatttcatattacatatgtttatatatatttatctacctatctattaatatctatctatttatctatataatttcaccttccagagataactactcttaatgtcttctgttggggaaatataattaaaaacaaaatctcccacctcagaaatcctctccataaatgtaataacaacaacaacaaaaagcagttttattatcaaacaagcattaaaccagaatgtaatacacatcataggcaatcactgaaagattgcgaagataggaagaaatctcacccccccatatagccaaataggtacaacccattgcatgttttcaagataaacaataacttgtctttaagtagaaggacttggcagcaactttgtcacacatggttcagctaaactttaactggtaattggagtgactatttgtgttaccctattggcttcatccagagggaaaataaacttcatatttttgagacaagaggtagctttacaagttggagccagaggctcatggaagttaagctcctgccttcccatagaaattgggagagtggagcaccatcttcctcgatgtttgcatttcataaggatggcccccgggtccttgagaaaaacatcctggatcataaagctgacaaagggcctatctagctttcaaaaggattgatatacattgcaaaacaaggagaaagtatttacaacgatctcttttctaaagcaaatgctctttaaaaaaggacggggtgggggtggagagaaaagtgtcttcctggttttcaatggggagaattaagcctcttacttttactttttatttgtccttacacttcctaattatgcatcctgaattctgatggcctcttactagatgtactgcttttatctcaatagtagtacctgcttttatctcaatagtagtttgtgaatatctttctaagtaaatgtaactaaatcagtgtgagggcaacagaaaaaataagcttctaccagggcaaaactttgactatccatgtgtctgaggcagagactcacacatagtaggagcccaatatatatttgatagttgttactttatttccagtctcatggggaacagaaataattttgcctgagaggaattgtgactagtaataacataatttcaggggatcatcccaaatccttcttgcaacaaatagattatacaaaagataaacactgtggagtgagttcagagcaaggcttagcatataagaagtagctaaaaatcgtaatgaattggaaaacagggaaggctgcattttatagtgctttgccacctggaaattgaaacaaaggcagagccacctagaaccagtgccaaagcaaatccaaaacttggcatatgccaaaatatattacctctaaactctgtagtttccattctttcatacttcattagcatatctaggaagtaagatctayttgcagcactttgaaaaaaataaataaatgacatgtagtttttcttttccaagaccctaaaagtttgttcttgaagatcagttgtatttatgcatataacatactcatatatcattcagatttttatgttcagtcaacttgtgttagaatatgaaggagtaaacttctcatcaactccctrgcttgccttctaccttaatgatattttaaacttactgacaaaggaaaatttaaagtgtggatattattagtttaatcaatactcattggattgtacarcgtaagccagacactgtactaggcatcagagatgcagtgatgagtgtaagtaatcacaagtatgcaaacaatagtgattaagcgtgattttttttttaaagcatggtaaatacctcatggagatggtgttaatgtaaggtacrgaaccctaattggcctaagagtttcagggaaggcttaccagagaaagcgactttagattcagataaagcataaataggagttaaatcaacatgggtgaaaaattgtgccaggcaaagggagcagctatcctaagatctgtaggtgaaggagaaatcactgtgctccagcctctaccgcattcttcctgcttttggacagaaaattaggaatgtgatgagacaagcttcttggggcccactgaattaattcccatacacttaccctattgaaaattctggataacaagatttatgccatagtttgattggcaatggcttacattttaactgttgacttctttgcatttaagagatgttaggcatgattttacatcagcacactagttaggaaacgaaaggaaaagggactagtaaaagagtccaaaagagaggggtatgagaaaaggagctttacctactccaagaggggtacagcttcaagttgataggattaatcaacattgtcacacatagttctggggagttcatagtgagataaagactatggacttggatgtattttaatgaagcaggttgtagtggggattcttttgttagtttgtctgatgggaatacaagctccagagacagtcctactctttccttctaatctgggctccatcttacatgtcatcttttttgtcccaaagtttttcacctgtaaaaagaactaatgttagtaccaagctcagcaggtgctgcaatgattacatgtgtaagtatatacaaagcagttagaatagtgtctggtgcatataaagtgctcaataaaattattatttaaagtcagataaatcttctgtcatattcaggacttctgacaggtttatgtccatcacgcaattatctttcaatagtacagatataattatatgattctccccatcacctgccaaatgaaaaaaaaaaaagggctctttagcttggcatataatggctttaatgagctggcccacctatcctgtttcattcctcatsattaccttccccctgcctgctgctataccagccttttcaaaagcaggtctctcygattctgtttataatcctgcctgaatagcagactatgcaccttcttcaagtgaagccttctttcctgactcttcttttctgcaggccagagcacatcccttgctttcatacactgtccctgtccctctctctttgttgcagtgcagcagcataacaggttgcatgtctcactcatcttcccttgttcagaatgtagtacctcatgtgtgctcaggaagtgtgtatggcatgaatggacaaagctacgtggattgagcttttgttttacaaatggagaaataaagagacgtagtcatttgcctagagtcacaaagtaagcagaagactggaaacttggacctgggttttgactcctagggccctggccagagaatttctgtggccacatctgattttttgtttgtttgtttttgtgttgtttaagtgatgtgggaaataatataagatataaagctgttaggctttgagttcttgtgtaaatataaaaacttctggttccaaagccttgtgtatggtcttcttagcctttatgcatgtcttcttaggaaatttgtaagagcagtcatttctggaaagtggaattgcaagtgccctttattttcatctgtttgcttgtccagcatcttctagtttttctagactaaacatatatttgttttataatcaggtgtgggaaaagggagcttaaatgtctaaattaatttttattccaggattattaagagattgtttttgcatcatggaatgtcttctgccttttgatatttcctcattttataatggtccttttatgtatctgaggggcctgtgtctgggcctatttctacttcactgtaccaggtgaacttctttaccaagcaataaagtcagaaatggtatattaatcacctatgtccttaaggagtgataataaatagtaattagtgtgaaaatatattctcttaggaaaacggtcatattatacatttgcattttatctggacttcatctagccaggattccactgagggcacttaaaggatcacacaacttgattttcttctctgctgtgacacaatagcctcactttgcattcgtttcacaatctgggatcattatccaagctcagtragaatcaatttctcatagatgattgcctgaatcactgccagctcagccacattttttacatcatttaccaggaagtatagtttttaaaaagtcagaacaattgtgcaggtaacccagaacctgaatatgccctcaaaatattcttcagaggggtcacccacccctgaaactcaaagtcttctgcaaattgattgacaatgttactgacctgtaaatcaaaggattccccatttcaattcaccattttctaagtgagtctctattgacatgaaagagttcattctcttttgaaagaaaagttcatctttagagagcagcctcaattgtttgctttttagcagaataattacatctttaatttctgtggagataatgaagaaagccagtttaggatatatttatgaggtttcagagtatatttggggagaaaattctataacttttaaatatgattctttagcttcaaaacgtacatgtttaggtaaattgcaataactgttttactttcatttatggtgattgcttgttcatgcttgagcacaagagagaaagcttgatttaaaacgtaagtctcattgatgagtttttatgccaccatcattttaaaaagtaaatttagtagaaagctaattttggcatataatgcaaattcctctactttatctggccttcatttaatgattttggagttatcactgcaaggtgtttatatagattagataccacagagatctaaggaactatatttatttgatcctaattaatatttggccttaaatagatagtcacaccactttccaatttcctaattttaagcaattaaacagctagcagctgttggccagataaatattaaactttgccaagtagatatatgcaagttttttaaccatatttggactatattagaatagattacaaaatgtgttgacatcatatactttagaagattgtatgttacaggttcatactgaacaattatttattatctgtttggtattgttaaaactcatgctaaaatatcatggatagttgtatactatctatgcatgccggctcatagtatgtgaagacacatcaaataaaaactcctatgastatctttacaagcgtgctttgtatttaaataacattaaagataattaaatattgtgttagtgaggaactttatttccttatttggaatattcttaaacttttacagtatgttctttttttgacagtgaaattgtcaaatgagcaatcacaatgataaagaatgaaaccataagtagtgtagaatgtatttatgtatttatttatttttttgagatggagtctctatcgcccaggctggagtgcagtggcgcgatctcggctcactrcaagctccacctcccgggttcacgccattctcctgcctcagcctcccaagtagctgggactacaggtgcccgccaccatgcccggctaatttttttttgtatttttagtagagatggggctttaccgtgttagccaggatggtctcgatytcctgacctcgtgatcctcccgcctcggcctcccaacgtgctgggattacaggcgtgagccactgcgcccggccaataatggagaatttaaagcagtggttcctaaattttagagaccatcagaattacctggagggcttactgaaaaaagattactggtcctgattttcagagtttctgattcagtaaatctgagatagaagccacaaatttaatgtctaacaaattctcaggtgttcctgatactgcagatctgaggagccaaacgttgcagtgtctagactctaggtcaatctcagcttatgttatcttaatttggggaatgaatgaatgatggagtgaagaagagaaagcacatgcatgaatatatttatttgtgtaaaagtgcttcagctctctggatgaggtatattgacatttaaaaagtagcagtattgcctcagtgtaacatgtaacaacattgaaaatgctattttcaaaagctgctatctgcatcaatagagatgagttaagtttttggacaatttttaatgcaacttgcattaatttccccatctggatggggcctctttacctacatagggaaattcctggcctaggtggatccagcaaatccttcattactgaatctggctgyaagttatctttaccttacactactcttgacacatttatccctagcaatttccaaggaaatttccttttttataatctttgtatttacctgactccagaagatcctgggtcctgaaaatattaagattgtgtttttcattcttatatatatatttttaagtttttaaagcctggtagtagagtccttttaaattgtgttgttaataatcctaataataataatttccttctaatatttttggctgttggtaatgtaatttatgggtatatccaaaatttttaaaataggatctgaatatttctggatttctattcagtaaaagttgttattcattctttgcttcagtagctgtttggagttaaacaactcatgtaattgtcacttttcaagtcaataatgtaaaccccacaggacaaattattttagtgccatacttacagattacatttttttttttaaagacagtcttgtcttgctctgtctcccaggctggagtgcagtggggtgatctcagctcactgcaacctctgcctttcaggttcaagcaattctcctgcctcagcctcccgagtagctgggactacaggcaggcaccaccatgtccagctaatttttatatttttagtagagacggggtttcaacatgttggccaggctggtttctcactcctgacctcaggtaatccacctgattyggcctcctttagcgctggaattacagcgcaagccaccatacccggcccagattacattttttgtcattgggctccattttkcttgaaatttagtctgtaaccctggggagtatgtttgaaagttttaatagttgtccaaaaaaatgttatctgtcagttcccattactctagcagaggatttatttgaaaatctcataatgaatggtagagcctgcatttgttgtgtaataatttcattcacttattcatatattcaacacatcttaattaagcactcctatctgccagcagaaaataaaaaagactaagtgccccagatggagcttgaattctaaaataacagagaacaaatatctataggtaaaggaaatgactcacagtgacacattaaactatactgtgtaagatgcagtctcattcatgaatattgagtacagtcattttagactattattctctggagatattctagaattatagagattaaaaccattgatacatgtagatcaacagctactaaattttgaagatcaagccattgtctttttttaagtaggtaatttttttggtacattttcaaagttgtaagttttgcaaattcatttttttatttttcatttcctcagactcaatattcccccttggcttaggaggattcacagtatacctccaggttacatgagtagctccaatcaagccatgcctaataatgagctagttcatgtggggaactcctgaaaaatgactgagctcatcccagttctcacagatatttgcaaccagtcatacctacttctcctttaaattctgtacctcttcttatacacaccctagagacagtgtgccaagcataacatcttaatctatgcccaatgcaagaaggaattctctctctttttaaagccatggaaaactcctcgtagtttaaagacagcctcttctccacctccctaggaagaatgttagacttagtgatggggtaattttctcaaaagtttgtaaaaaagcagcttgtcattttggtcatattattaccattaagtacaggaagttaccttcagagtagaattcagtaggcaccattccctaagtgtaaatctccttcactcattaaaagttctgcaccacacccacactgtatatagtattggaagttgctcaggagtcttggctgctagtaagagaagcctgagaagtactcatgctctgatctgagtgggaaatagttgttcagtgctcttgaaattgaaacaagaattttctttcaaccagagaaatgggaaaggayttagtgattgcctgtaaaaacctaaggaactgttcaactatatagagccactgtttggccgcatggaggatcttaacacatccctaggtattcctgtatgtggtaataaccacagacatgggaacagcttttgaatcctaagacctgtaccccagtgaatataatgagagagaatataagtcaragagggaattcaaattgttcctctgggagcctgagaaatgtaaaaaactggtttactccctatactaatcctaaaaacagttgtcatcactcttaattcatttcctggaaaagagacaactgacaacaaagtagcgagaaggtcccatagagctccaataaacagtggtagtaatattttgtatcctgttgaacaaaataggaaaccttgagttcaaattaatataaattgagaattgaaaaaaataaatttaatgaagaatgagatattgctataacttcaaaatacctcccctcaaaatactttctaattacaagacagagaataatattgcagtggaaagcctgacagatrctttaatcaagtgatcaaagtaaacgtcagcaaaaattacctttacagagatcctgtaccactgactaagatacagtgagaagaaaagagcatattttttgtgacgtttctaataaaaatgsataacctgaagagacatcagacaaactcaaattgagggacattctataaaataactgtagtcttcaaaaggattgagattacgaaagtcgagaagagatggaggaactgtgtcagattgaacgagagaggacaagtaaaggcaacatgtgttactgaatggaaacttattccctaaaggttattatattggcaatatctgaacgaagcataaggactccatggtactaatgttatcaatgttaatttccttattttgaagagtatattgtgattatataggaaaatattcttgtccttaagaagctcaggctgaagtactcagtgtcagtgggatgttggcactattcactccagtggttcaagaaaaaaaagtctgttctgtacttgaaccttttctctaagtttaaaattataaaaaaaaaaagatatacaacaattacttaataggacttgcattttaaaagagaagtacaagttgaagaaggttaaaatgaagccttttaatatttaactccatagtcctatgtgttgctctgctatgctgacgatgcatgaaaattttaattgcttaataagaaagaaagggaaagataatatcatagagctcacaaatatgagcctaccaaagcagaaattagattatactagtttcaactattgaattaccctgtagtttaaattgaaaaacaaagataaatcaattagtaattctatatccagtttaatgatttttccataaaaattatttggcttataaaacaatacaaaagtctaagaaatatatcatttaatatgggcttccctttattcatgtctgccagcggttctaactaaaataaatggaagcrggatgttgcactgaggatttgctttgtagctctttaccagtttattagcctctatttgaagattttttttttatgaggccaaatccagactaaattaaatagatctggcatggtaacatatcattttgggttctaaataagtgattccttttaatgtgcatactgaaattttctcacatgacaaactgggacacatgaaatggaatttcacgcactattgaactgaattctcrgtagctgctgtgaaatgtttggggagttttagtggatttatccattttagtgaccatatttcccctcacatttgtgaaatgcattttgctgttattttagttattctgaaaatgtgaattcatttacctgcctgttcaragaacaggcatgagagctaagggaaatgatgataagcacaataacaacaacaaatacaggtgatattcactaatttattcattcaatactaactacagggactaatattgaatgaataaattggtgagtatcacctgtctgttaacagaacaggtaagtaagtacctgctctaattaagcttacattctattagaaagaaaaagaccaaaaaaagcaaataaataaataattgcagagtatgatagctattgtgaaaagaataaacctggccaaacatggtggctcatgcctgttatcctagcgctctgggaggctgaggcagcgggatctcttgagcccagtagttcaagactagcctgggcaatgcagtgaaaccccatgtctattttagaaatataaataaataagaataaacatgttgatatgatagacaatagcttagcaaaggtggggaggacctttccaaatgggagacatttcatctgaggtatgaagaaagaaaagtagccatctggtgacaagtagaggatgaatgtttcaggcaagggcagggaaagtgcgaaggcactgagataagaaaagtggctgcttatggaagagaaagcagagtgtgataaaatggagagtccagcagccattattttgttatttaaacctcacagtgatgctgtgaggttggtcctcatacaatccatttttttttttttttaggtaatattcctgaggaatagagaagtgaagagacttactcaaggttatttgttgataaatggtagagacagtgttttcacccagaaagtgtgacttcagaacccatgcattctgaacattatatagtgttacttcctgtgaaccctaaaaatgtgagacaggtctcagttaatttaaaaagtttatcttgccagggttgaggatgcaagcccataacacagcctcaggaggtcccgatgtgcccaaggtggtcagagcacagtctggctttatacattctagggagacataggacatcagtcaacacacacaagatgaacattggttctgtctggaaaggtgggacaactcgaagcaaaggtgggaagactggaagcaaggagggggcttctaggtcataggtagaaaagagacaaatggctgcattattgtgagtttcttattagcctccccaaaggagacaatcagatatgcatttatctcagtgagcagaggggtgactttaattagaaggggaggtaggttggccctaagcagttcccagcttgacttttccctttagtttagtgatttgggggccccaagttttttttcctttcacatttcccaaagaaagtaccacgcacatatgaattactgttgttataatgataaagttgaaggcatgttttatagcctagaaaactcatctatattatcatattttgctccattcaaaatactgtgcccaactctaggtgctaaactttaaaaagattatggacaaatcggagagtatttggcagaaggccccttgattggtagaatcttgacatatgaggagcagttttgactgtatcatgaaaaagataaggctcaggaaactacaaggtggtcagagcacagtttggctttatacattctagggagacatgggacatcaatgccagtattgatatatttatggggccttcatatggaaaaataactaagcattttggatggcccccagtaggtacaatttggagagaaatataaaagctacagaaacctactttgatagaggaaatattttttttcacattgaaaaatccaaaattggaataaagtattctgggagagatagagactccaatatcaaaggtatttaaatataagtagaaaaacctgttattgagagtgtcctatagtgaattcaagcaataatgggtaattgaactgtattagcccattttcatgctgctgataaagacatacccgmgactaagcaatttacaaacgaaagaggtttaattggacttacagttccacatggctggggaagcctcacaattatggcggaaggcaaggatgaccaagtcacatcttacatggatggtggcaggcaaaaaatgagagagcttgtgcaggagaatgcctgcttttaaaaccatcaggtctcatgagacttattcactatcactagaacagcataggaaagacttgcccccatgattaaattacctgccaccaggtctcttccacaacacatgggaattcaagatgagacttgggtggggacacagacaaaccatgtcaggaactaatgtggtttttcccaatcctgaaattctttgatggacaagttatcatcagaagacaggataatcagaaytcaacatacttgatttgacagagcatggaatagaaacctgatgccagatagtgataaagaagcaaagtaaaatccaagatagtaggcttgcaatgaaatacagaaactgccatgtcttctctagttatcaaggggactggtgatctggctcagactagaaagcgggagtagccctgccctgccttagtaagtatgtatgcaaatttctacactgaatattatctcctcttcaaaacctatactgagaccccagggaagtgatcatgtgcacaatccttattagattacctgtaattctcgttgcattgatttgtttatctgtatgtcttcttcttttagcccttagtctcactgaaagaaaattcatatttgtattttcagacttaggagtgttactagaaaatatgtaataactaatacaacaagtagcagactgttgaatatccagggaataagagaagttcaaacaaagtcaaatttagaaacagaacgtatttgtggccataatttattttctaattacccatcaaagttatagatatgtatgctttgaatatggtatcagaagactaagtcataaaatataattttgatttagaagattataagatccaaatgagtcaatacaaggcatgaggaattatgatcaaattagattttagatctggaagatttcttccattttatgttctagagttctaccaagtgaaatcacaatgaattaattgagaataaatgttttattccaaatcagtttgtcagtttttatagagatatgatctagaatcaacttatttgaaacttccaaaattttagttcaatttcttaaacaaaggatactgctgtcttcttggagctgagagagatacaacctcattgctactagcattacctttaccacagaagaaaaaatactttgtaataatttttgatattactagtatcacttttaaaagttttattttgagtagtgaaaaagagtgatttatttgaagaaatgtcctaatatgactctgatgtgaacacctttcagaagtgtggtgtttattatttggtagtggcaaatgtgaaaacataggcattgcattcactaaactatagcgaacagagaatttgctgacctgtaagtgcattgttgacttttaccttgtccttaactttgacccttcctcagtattaatgagttaaaaatgtctcaaacaggtgtcagctggggttctcaacctttcaaagatgtgagttatgctcaaaagccagcctgcctcttcatctcctcaaattccactacctgtagaagtcctaagccctccttagaatttctgtgacttctcaggggttttcacttcttagtgcctgcttcacttcctttgccccagcttcctgataaaccttctctgtccagttaaacaaaggcaaggaacctsctcatccaaaaagagaaactacttaaatatactgttactgaatagactgttagagaatcttcccctgggctgaaaaagtagacacaagtttagatacctttaaatccatgcgagtgtatttwtttatttattttwttttttttgagacggagtctcgctctgtcgcccaggctggagtgcagtgacgcgatctcggctcactgcaagctccgcctcccgggttcacgccattctcctgcctcagcctcccgagtagctgggactacaggcgcccaccaccatgcctggctaatyttttgtatttttagtagagacagggtttcaccgtgttagcgagcatggtctgtatctcctgacctcgtgattggccggcctcggcctcccaaagtgctgggattacaggcgtgagtcaccgcgcccggtgagtgttttttttgtttgtttgtttttggttttttttagcataataaagacttgaaggtagctggcacctgtaattccagtgctttgggagaccaagacaggaagattgcttgaggccagaagtagaagaccatcctgggcaacayagagagactctatatctacaaaagaattttaaaaattagctaggcgtggtggcacatgcctgtagtctcagctacttgggagactgaggcagtagaatcacttgagcccaggagttcaaggcttcagtgagctacagtcactccactgcattccagcctgtgtgacagaatgagcactgtctcaaaaaaaagaaaagaaaagaaaagaaaagttttgaagaatcaatttattaaaaatcaaatatagttggctttcataatgagtttaataatttactttgagattaataatcccttggcaatgactcctaacattttagtttaaagcttttctcttagcctttttatgtatacatttaaagagcagaggcacatgctaatataatgaactattgcaatgagtctatttgcaatgtaagctgatgatcagcttgttttagctgatttataaattgccaygtaccagaattacttatactaaaacacataatttaaacatcatccttaagaaatgagatagaaaaaaggaaaagggtcagtattcaggcttctgccctgcttatgagtctcttgattgacactaattaaaaaaaaaataagtggaaattcaggaaagaggttagaggcagcaataggcaagctgtttaatgtcacatttgaaaaaattatctctaattcttgaagtcacttttaagattttaaaaagtcaagccataaatttgctatctttaaatagsagtttggtttaattatcacttaagcacttttttactttctcattttaggtctttaatttgggtattaatttttcatctattttatatttcacaggttgtattgctctcattagactgtttgttacaaattgcttgtgaagaaatacattttaggtgtcataattttcctcaaatgatatctgtatgagtgtctatcaaactttcacttggtttgaaaagacaatgatgcaatagtcagactgggaaaaggtagatgaatggaaaaggcaaacaggtctttatgaaaaacaatgcagatgatctctggtgtcacataatgtttattattattcagctatgtacatacttgaaaagatccattgtcattaaattattttttatgtcagcctttattatcactttgcaatacaaagaaagcaaggtgaagactaacttttctcttgtacagaatcatcaggctaaatttttggcattatttcagtccttggagacatctgagagattccgggatgccagtggtgcctctctgkccacactgacaacaaataattcacctraggaatagttcacttcagctattttttgctactcattggttgtcagtgccattgaggagagctcagtgtagatcaaagaaaacggtgtagatcaaagaaaacrgtgattcggtgattgttccccttcttcccagccacccaccatctgaacctaatgcatcattgtacaatggccgtaaaggatgacaagggactcagcaatcagttcctggaggaaatgatgctgtggcttttggctggtggcaccatcatcctcagtcatcagtcagagtcatcaaagtgatcattcatccattcactccctcctctgtctccaccccacagctaatcaactaaccagttctgaattttttctcaaatattaaatcttaacttttaaatctttctcaaatctatctttcttcttatctctgccctagtttagatccgtaataatcttcaccttaccaattggtagaaccttctaactgacctatctccttcagttttgtcttccttaactctgtaaccacagttacttccataaaatttaaatatgaccgtgacacttgcatcttaaacaccttcaatagcttactggaaaaattttaaagcccttgttctggcatgcaaagcccccaaatttttccatttattcttacagcccctccactcactgccttgcattccatgtctgagcacatagaacctcctactattcttcccaaacagccatgcactctgtcttcctagatgccttcagccatgaatttcttccttaccttcagttggatacctgtttattgagacttatttcaagtaccttttttatctagaaagccttacttgtctcatatcccatctgggttaggtatctctctttggtgtccctggaataccctatgcatatttctgctattatattcattagattatattataattgacagtttttatatctttggttctcactagaacatgagttctttgatgatggcacttttattcatctttgaatcttttgtaccaggtagatattctgtctcacactagacacatcataaatatttgataaattagtaaacaaatgaacaaataaaagctgcaatcagcagcgttaagttttcatgggatctgtggataatataaaatacagaattcccagctgtggcagcagatttattgctatcataatggatccacagcttctttcttgttccttgaatgtgaccagtaacaatgcacctaggagatctgatgtaagagtattctgtgataagtgtatacagaaaggaggaaccgatgactcaaataggaatcaagccagaagcttctgccatatgggcagcatggacttcaaccaaaacaatgaaacaktgctgtggtttagcagaggtcctaccatgaatagaaggataccaggttgccactgtgtctcagactgcawctctgtgtcrttgacccttttaccaaaggtaggaaacagagctgtagtcatgccccatatctataataagtatgtggataataagcatcgagtacagccctgatggtagtgtcactgtcagagacttgtgttgttttccattgcactgctatttctgtgctatgagaacttagctcatcagttattgaagaagggggaaagttaatgaccacaagagggcttatgatgaccctaaggcaactttcagagctattctgcaagaagagagatttttatttcccaaaccagggggtaatttccaccagggckttgtttgtttgtttgtttgtttgtttgtttgttttgttctgcatttgccgtctcattggtaataacaagactgcagcaacaaaggaaagaaatctcacyccatttctctcataattccataaatagtttgcctgcctttcattgagggcagttagttaacattgaggrcagctagttaacagcaagagctacagaaaagtcctgtaattaatcaacctgcattgccttcagtctgaatctgagtattaaaattcagtaggtgcaattagacagaatcaggcaaatataaaggtcataacattagtcacagtgtcaccttatttctgagccttttctttcttctgaagtrgtgtcttgtcagtggggtgatagagcaacaagaactctctgttgttatgggagtttgttaaattttatctgcgatttttccaattttaattaaatacttgataccaggctgcagcaacagaaacactgctgtattgggtttcagcactatcactctatcatcttataatttaaagtgaaagataggaggactttggggttctgacggtttgatagctttttaaaaattacctttctttccccataccagattagagatgggggtggtggggagagagcttcascatcctctcgccagaacttccggttctctagctttttatacatcctactcacactcgtcctactgatttccacttaggactgcaactacccgtcctctctgcttgtccatcaggaatattgactttcccaaacatttcttaaaaattgaaaagttaaaccaaaaatacacacttttattttcttatttttattttttctaagccaaactgtatccagctttattaaagacactttccataaacaatcctggaatttcagtcaggacatgggcagacaattattaacagtatacaacaactttcaaaaatccttctctaatggactaccaaaaatcagaaagccactataaaactcaatgaagtcttcatctgatgcactgagcagggaaagttttgagtgagggttgacatttcacatttagcatgtttttaacaacttttcacaaccgaccctgactttcagaaatgaaatgaaartggcagaatttatttgaagattcacaatctagaaacataaccactgctcttttgaggcacgccatctcagtggcaccactggaaagtccagattgcctgatgcattggtgaccaattaatgggattccggtcccaacagatgtctgggtttaagggagttaagtctatgctggaaggtggaaagggagaagaaaacataagaactaatttgttttccataccacaaggcttttgcaccaaggtggccatgtatgtcaaagtcaggaaatctttcctcctgggaaccaagaggaagtctctcaaaactagaagggaaaggtgtttcacacatcaatccagatttggagacatttattagtgacatatgctccttcccccccaaaaaacaataatgaaatgttgtgtcttaacaacatagcttaaaaaaaaagtaaaacaaaattctgcatttttataaaacttgataaaaatatttcaaactgtacggtcaccagtgcacagttatcaaaaatgcrcacacttcgcttggcatttccagcaccttcagctttctgtgcctggtctccatttctgcagggttattcccctccttgccagtatcatcttttccctttttccctctgggtaccttctgtcccttctttgcagggcctttttaggcctgggctctggctttggaggagcaggtttagcagacaatctcgcggatcttctctgtggttcatccttcactttggctgtatctcctttcgcatccccttcagcctttctcttgggcatggtggcggcgatggtggtgggatgtaggtgctgggtgtgggatgcagctgggcacggaatgcagcgttgcacgagctttggtctgtccwggggtcattctcaccactgcttcttccaatacacacttttaaatggtgcttctatggtctcccacatcaggagagccctcagtgctttccctcagcctaaaagtccacgattttattcttcactatttcctcaagcctattctcacacctgctcctcccttgcagtgaatgatactgattccagtttttctgagaaaatagggaaaggcgctgaaaagattgtactgtctgcctgcccatttacatatattatctgatttaatttgcacagtctgagatgtggagattattctttcttttacagataaggtaactgaggctcatgtaagtggtggtgctgagactgagctcatgttagttcaactgccaaacttctcctcccatgtgatgggatgcagctgtaaaacagaaatactagggcatgaacatcagatttctcacttccctattctaaatatagctaaatccatatgaatacatattccatgactctcttgtgcttctttcctccgttaggctaataatagtctattcatgctttgttttttctcttttgggatatttgatcatcaactttccataacttcaaactctttcttttaataattctttcctctcaatatatacacatacttatgtttccctctgtcttaaaaaaatccatttctcatccttgcgtctgtctctgtgtgccaccttatcatccttctttcgttcacagcaaactgtttttaaaaagtgctttaattctactggttccctctaattcactctgtagtcygaattgcaagtctatcatttcacggaaattgatttattctatgaatgtggggtttggagttgggaaataaccaaatccaaactcattcttcactcatgacacttagacggtctctgctgtgtatgatacccactttgggatactcattgttgaaaccatgtttctatgactttcatgataccattttctcctgggtttgcaattccctttcaggccactcattcttaagtccatttggtgccactgctcccctttatgctgcctaaatgttagtgctttccaccatcttatcactgatcctcttcttgcttgtcaactttgattgaagtatttcacccatatctgtggttataaatgtatgctatctgtacactgatgttccccagaccagtgcctcccagacccatattttttgttgtttaatgaacttccattgaaatttccaagtctgcaggttcaaaacgaaattcaaagtctttctattcataatctctaccaacgtgactggtaccatgatacactcaggtatgtccccgtcgggattttagaagtcatcctttgccattctcccttcctcactcccaaataagaatcctctgraacattcctaaccttcaaaatgacatcttttgttgttgttgttgttgtttttgagacagagtctcactctgttgcccaggctggagtgcagtggcacaatctcagctcactgcaacctccgcctcccaggttcaagccattctcctgcctcagcctcctgagtagctgggactacaggtgcccaccaccatggctggctaattttttgtatttttagtagaggcggggtttcaccatgttagccaggatggtctcaatctcctgacctcgtgatccgcccgtctcggcctcccaaagtgctsggattacaggcatgagccaccacgcccggcccctagttaatgactttcttaaatatcataatgctaaaaggaatttgtgctagaattttcctaaataaattgataactaccttctctgacctgtaaccccctgccaatwgcatatatcagccagacttgaaaagattttttgctgtcctgatgtgattgtcccattagtacagaaaacaaaggaaaatgtagtttgacgaaacaggttctcattctgaaattgtttgcatttgatctgcctttatttcagttttaatagcagctataatcaacgttgggcaactgctttgctctttctagctgcagaaacctctggccaaaaacacaaaaaggcacactgatttgtgcatggaaacacatcctcattcttattttcaacatgagaagttgtcacagacatccctcttcctttgctttgagtcagtttatgtgatggcatttatcattaagacatataatctgttagtgattgttattcagcagcttttggttttagtttcttatctttgaggaagccccttttttcaaacagctaactcttgcatctaaaaagtgtcttcttaagtatatcatctttccattttgctggaattctaaattttatgctacttatcattgaaaaaatactgaattacttcrtttttgtattttattaaactaaaatttgaatccaagtcactcaccactgatagctttatactgtttaaatgactttttaattttggtgtttgggtatgtttgttagcatgtagaaagcaagcccarggtaatttataaagctatgacttacagtgtatggagcactaagtagagtttattcaaggcaactggtgctagatgctatgaagattactgtagtcttcacttcaatattacacttattttgccttttcagaatatttttatatgtgaatatgtggagacacattctttttgaggcggtgtcttgctctgtcacccaggctggggtacagtggcatgctctcggctcactgcaacctccgcctcccaggttccagggattctcctgcctcagcctcccgattagctgtaattacsggcgtgcgccaacacgcctggctaatttttttgtatttttagtacagatggggtttcactatgttggccaggctcgtctcaaactcctgacctcaggtgatctgcccatcttggcctcccaaagtgctgggattacaggtgtgagccacccacgcctagctgagacacaaacattttcttacctcaaaacctggactacacaagaaattcattaagaatgaaagtaatatatattttttcttaacaatatcttgatctttaaagaatcagttctatgtatactgttattaaaatctgattaaatagcaatttataggaatctttaaaagaaatcaacattgagatttttattatatatctattaattttcagtggatctctgctgaataacttacaaacaattataattatttttccattaatctgatatttgaaggtaagactcaacaagaacaatgcaaaaatgagagaaaataagagggaaacattaatttttttctttgacttttatttcatctgcataatttaatcattttttccttcaaatattcaaaaacctgcattggtatttttttctgacacatttcccctgttagactttagtttttcttagttcatattcttgtgttaatggctggtggagtaacgtttcctcacacacaatgttttttaaggtatgtttctatctggaacactaattggtcaaatatgtatagcacatgaacattaaagggtgctaactacggttatctcactgaagcattttttttttttgtcgttcagcaaacgttgatttaattcttaagtgccaggctctaagaaaggtactgaaacattttcttccattaaagaaacataaataagagacagacatattgtagtttaaataagtacagtgatgctgtaaaaatcaaattaagacaaataggagatgtctatgaaaatggtcattacgcagcctctcccttcctgcctatcctgcattcctgcctgcttagtttctctgatgagacatctatgagctccttcctcttccaaagcctccctgcctctcactggtctccccaggcacatggatcataatctgcctttctgtctccctctgtagaatacccctgcattcactctgctcattggactaagctggcctgctcactgctgtcagcattgcctgaacttttctgccaccatgagtttgctcaggctcatcattcagcaagatatgtgcttggtttctcctctgcctgtcataattctgtccatccttcaaggcctgcattagtgtgtcttgttatccatgtttactttccttcattgcatctactcctttttagcatttgtctatttatttaacagacccccacccttctggaatgtaataataaacacacaggcaagctaacaaacttgaactcatgcgtatcccctgcggagcctagaattgctttccattccgcttggaatagaggatgcatacgtatgcaaatattgaagacattcatttgatgcacaaagtctatttcacaagcatttaatttctaacatatgccagactcagagtttggcaatggcatgtagatgaaataggcmagttaacagacaaaatacagtatgttaagtgcttcagtggaggtaagcatgggaaatttataggagtgttactaattcaggtragtcaatgagtggatgaaagcatggataaatatgtaaatgaataacttaggttaattctctggagctcctatttagtattctgctgtcctctttatgtgttaatcagcctgataatctgctgcaactacaggcagtgtcctaatttcttccttcacaatagttcctaataacactcaggtggctacaatatagtgaattctgtatacctgctttctcagatgcatcatcctggcctttaaccactatatgaactgatgtctccagttgccacattaaacatattaatttgggaattcaaaaaagtaatgtttaaggccaggcacagtggttcacacctgtaatcccagcatttgggaggctgaggcgggaggatcacaaggtcaggagttcaagaccagcctggccaacatggtgaaaccctgtttctactaaaaatacaaaaagttagctgggcgtggtggcacttgcctgtaatcccagctactcaggaggctgagacaggagaatcacttgaacccaggaggcagaggttagagtgagcagagattgcaccactgcactccagcctgggcaatagagagatgctctgtctcaaaataataataataataataataataataataatgttttagaataagattagtctaatgtttcattattaaagcagataaaatgtatttaatggttcttttgtctttgttttattcctgtgcacaattttttttttgagacagtcttgctctgttgcccaggctggagtgcagtggtgcaatcttggctcactgcaacctccacctctcaggttcaagcaattcttctgtctcagcctcctgagtagctgggattacaggcacgcatcaccatacccagctaatttttgtattttttagtagagatggggtttcaccatattggccaggctggtctcgaactcctgacctcgtgatccgcccacctcggcctcccaaagtgctgggattacaggtgtgagtcaccacacccagctcctgtgcacaatattaacacttcactagtttatttcctttgtttttctactcgtggtgatttgaaacagtctttcttttagagtgctttgcatgaagaatctcaagttcttattttttcaacttctgtttatttttctgtttgttggtttttccactaaaaaaaaaatcattttttaagttttattttggcctcttttattttgctttttaatcatgaaaattaagaaagcatgttgagcccacaaggtactaagtactattgttgacagctgaagtgatacctcagttcttcttggtttaaaatagtttaaacaagagctacacagcaaaggaggtgtagcatagagtartttattacaatggataaagatattttgaaagttaggtgcagaataaacagtataccctgagagagaaagaagtcaggacaggctgcttgtaagggtgagacagcaaaaactggcactagggagacacccttttagggagttttaggtggggacacagccaaaccatatcagacacctactatgtgtcattcgttttttcttcagtgcttggatgttgaaataatgaataagcataagactccctttttgggagttttaaaagatgattcataaggaggtgggaagaggtgttactagtaagcatgttctgggtggtcttctggtgcacatgtgcagtaactgtacatgcttgttcatatgttgcatgtytcattagcatcttaaaactccacccaggggtgtggtttttactattataatgagcatagggtcagtttggggacaggtaaaatcaaaatatgcatgctctctagaagggaaaggccctattgaagatagctttgcttgaatgagctcaattacaatgcaaatactgaggtttattgtgctgactgtatgatcaccatggttgccccatcccaagaacatggtcacttccttgactgcctatcctgcctcactatgatctagtaggtgatttaaatttggtccacactcagtgtaatcattccatgcactttaaacataatctagttacctggtgtcattgcgctatatgttgtcctaacctcgtgtagttcagacttcaggtatctctgatacctagccataaaagtttagtagggactactcaactaaattatcatgtaacaatcaaatgagacctacagctgagtaaagaaatgcttctcttattgatcaaatttttttggttattttttcattttcatgccatgttatatttgatccttacgagctcaaactcataaaacaaaaggccaccacttcttgttggtttgattcagttattcaacaaatgtttattgaacactgtataagttcattctcatgctgctataaggacatacctgagactgggtaatttataaaggaaagaagtttaattgactcacaattccgcagggctggggaggcctcgggaaacttacaatcatggtataaagggaagcaaatatgtctttcttcacaagacagcaggagagagaagaatcagagtcaagcgaagggggaagccccttataaaaccagaagatctcatgagaactaactcactgtcatgagtacaggatgggggaaaccgcctcaatgattcaattgtctccacgtggtccctcccatgacatgtggggattatggggactacaattcaagatgagatttgggtggggacacagccaaaccatatcaaacaccgactatgtgctagtcttttttttttctgaagtactgggatgtagaaacaatgaatragcataattaatatgttaaragaagaaaaatgaagcagggagagggcaaggagagttaccaagggaggaagtatactatttaacagggtggttcagcgaaagtctctcctgtaratgcttttgaggagagatttgattgaagttagaaagcaagtcatttgagccttacagacatctgtggagagtattgcgggaataggtgatagccagtgtcaagcttttgcatgctcaagggacagaatggaagccagtgtggctggagcagagtgatcaaagcagaatggtagagaaccggagcagagaggacatgagcggggacatcatataggatctgttggccataacaaggagctcatgttttattttgagtgagatgaaatagcattgtagccaaggagtaatgtgatctggcatatatttttaaagtgtactttagttactgagttgaattggttttcttttgctgcataacaaattactacaaatttaccaccttataatactgcatatgtgttatcacacagtttctgtgggtcaggagctgaggaggaagggctgcttagctggcttttctgcttagggtctcacaaatctgaaattaaggtgtctcatttgaagcctggggtcctcttccaaattcacttaggttgttggcagaattcacttcctggaagttgtaggactaaagtccctgatttttgttgttgtgtgtttgtttgtttgtttgtttgtttcactggttgggtgttttttgttttttgtttttgtgattataagcctggttatgctctcagctcccagaggcaggtctcagttcttagccacacgccagctcacaacctggtaggtcacttctccaaaactagcaaggaaatctcctacattttgagtctttctccaatttgctgaaatggagctttctataacataatgtaatcaatcacagcagtaatccaccatcctctttgccaacaaatttaacctaatcaaggaagcgactctctcttcatattcataagtcctgytcatgcccaattggagggaattgtacaggatgattacatcatagggtggaaattttgggagccaagtcataattccacttactacataggtggtactactacagaattgtgaaaggagcaagagaagattctgaaaaccagatagaaggcactagtggagtctaagccagtgtttccccaagtttaatgtgtatatcaatatcctaggcattttgttaaaatgtagattcagacttcataaggctataatagtggcctgaatctcccaacaaactcctaggtgatggcgatattgcttgcagagtagcaaggtacaggcaaatgatgacagtgacttgggttagggtggtaatagtagagataagaagaggtctgattagggaaatattttgaaggcagaccctaaagagcttgctgaaggagaaacaaaggcatcaggataacttcttacttcaggggatgtcaaagactgtgtggaaggagcttatttcagagcagaaaagagttcagtttgtgatatgctaagtataagatgccttttaggttcccagtagagagaatcacaaaatgcgatggaaaatagcaggtttatacattatattcagtgttattgaagatttaaaattttgtttctgtgcaccacaactatgtaactctttctaagtgtgcttagaatttattatattgtattaaaaatgtgagcaatgaagaggacctaactgatttgtgctgcagattctctttcattctcttgcactgacattagtaaaataagcagtgttttcttgtccctatgccagagttccttacagtgaaataaacatcattactcaaatcattaaaactgttcctagaatccaaaatacacatcactgtgcatatttaaaacacaatgtattcaaacactctttgggtacagacctagactttaagatgattttcagtacctattgattctggttgatgcctcaytatgagatgtattaccagattttccatgactgtatagacggcttcatggtgtgactaattattatttattttcagggcaaaattatgcaatgttattttcatcacattgtgagaggtggccattagatagagcttgcataaaagttagttctcactgactcacttatcacaaaagaagacagtgtagactaggattttatcaaagataaatttacttataatcccctaaacctcaatcatgtaaaatcttggccttacccgttctcattttcagaaagaaaagcattcagaagaatataaaatgaaaactacrctgccactcctttcttccttgtgatggccatggaaatgctagcgtttaaccagagacttggactctcaatatttcaaatgttttaaaagaactttaagtagaatatacctgtgcttagcactgcttgggtgctaagttaacatgcagtgaaataagattacgggaggtgattcatggtttcaggtaggggtgaaataaaggcaacaaagggcagtttgggtttagaggacgcttcatactgtggaacatgtgaaaatttagtttattttaagcaaaaatctttatagaaatccctgttttgcttttcttattgttaaacaataaaatgtgctaggctttacgaccagagaaaaatgggaaggagatattttaaggacagcctgatgattatgtttttgtaaataagatcccaaacagatggaaattaaaccaaatctttcaatgacagagggtgacagtaggtctgaaggcagctacttttatggagagtgttgaggaagtcagaactttactcctatatctggattcctttcaatctggaatcctgggctaggactaactaccttacaggacaattaagctttttgttgatttgaaagaattgtgatgactggacaaagccattgctgaaccctgaacttgtcacattatgagaggtggccattagatcaagcttgcataaaagttagttctcattgactccctgatcacaaaaagaagatgttgtagactaaagttgtaccaaaccttggttgttgttctatagacttgtttttttatagtggcatggttgttctacagaccttttgtagtgtttcgtattgaaatccagaatctaaatacaggcataattatttcatgcattagttcaaagatgtcaaacatttttctactattgcatctatttttatgtaatgtattaactataatgtaaagtttaatttttgcatggtaatttaagaaactaaatttcttactcctycttttccctaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacaggtaaaatatttgcattctgtttgcctttaatatatttttcagacctggagtatgtttagactagtttcatctcattttcctttgaatagtgtactatgaactagatagaagttacatgtagaagaaaccaaatggagcagagaaaatgggaaatttagacaatattttgacaatttgtacaaaaaaaaaatgaccaatgtcatcatgtcatgttttcctacaaggtaacaataatgatgctgcctctagaagatgtgataatgtratttacagctaatataatttagtcaattacttagtcaatcaggatttctttttcttgagcattatagtttgatcttttctgcctagcctcatgttatagtcagtatttggatatgaaaaaagcaattggctataattgaaatttaagaaaataaattcctagctcttctatatagaaggtttaaagttgtatcccatccttaggaaaccctctctaagtgtctttttattgagcctatcttttttttttttwaaaaaaaagcaaaatataatacattaaaatttaagtacaaattctaataagctatacatagataaataatttccaaaaagtgacaccttttcttttttgatattctagtttttttaaaaattgtattttgggaaattatgtaaaggcaaatatacacgtaagacaaagaytagaaaaatattcaaaattataatagtagctctatggggataagctttatcattggtgaattttttttatattttctatatttaggtaatgtaattatttgaacataataatttaatttcaaaactcaagagagtagtagtcaggcactgtggctcacgcctgtgatcccagcacttcgggaggccgaagtggctggatcacttgaggtcaagagtaccagactagcctggccaatatggcaaaaacccatctctactaaaaatacaaaaattagctgggtgtggtggcacactcctgtaattccagatactcaggaggctgagacacaagaatcacttgaactcaagagttggaggctgcagtgagccaagatcatgccactgcactccagcctggacaacagagtgagatcctatccaaaaaatcaaatcaaaacaaacaaacaaacaaaaaacaactcctgctgggcgcagtggctcacgcctgtaatcccagcattttgggaggccaaggtgggtggatcacctgaggtcaggagttcaagaccagcttggtcaacatggcaaaaccccacctctactaaaaataaaaaaattagccaggcatggtggtgcatgcctgtaatcccagctactcgggaggctgaggcaggagaattgattgaacccaggagtcggaggttgagtgagctgagattgtgccattgcactccagcctgggcaacaagagcgaaactctgtctcaaaaaaaaaaaaaaaaaaatctcatgaaagtagagatttttctacatcagtgcctgatatgtaataaacactaagtatttcttgaatgaataatttttaaaattattatgttacatgtaataattacctaaaagtatattgtcccaaatcttgacattattattttcagttttgaagggtgttagaaagcagtagggcatggaacctctgctttggtttttttatttttattctttttatatatatatttttattatactttaagttctagggtacatgtgcacaacatgcaggtttgttacatatgtatacatgtgccatgttggtgtgctgcacccattaacttgtcatttacattaggcatatctcctaatgctatccctcccccctccccccaccccgcaacaggcccaggtgtgtgatgttccccttcctgtgtccaagtgttctcattgttcaaatcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatgtgtgccacattttcttaatccagtctattgttgttggacatttggattggttccaagtctttgctattgtgagtagtgccacaataaacatgcatgtgcatgtgtttttatagcagcatgatttatattcctttgggtatatacccagtaatgggatggctgggtcaaatggtatttccagttctagatctctgaggaatcgccacactgtcttccacaatggttgaactagtttacagtcccaccaacagtgtaaaagtgtttctatttctccacatcctctccagcacctgttgtttcctgactttttaatgatcgccattctaactggtgtgagatgatatctcattgtggttttgatttgcatttctctgatggccagtgatggtgagcattttttcatgtgtctgttggctgcataaatgtcttcttttgagaagtgtctgtttatatcctttgcccactttttgatggggttgtttgtttttttcttgtaaatttgtttaagttctttctagattctggatattagccctttgtcagatgagtagattgcaaaaattttctcctattctgtaggttgcctgttcactctgatggtagtttcttttgctgtgcagaagctctttagtttaattagatcccatttgtcaattttggcttttgttaccattgcttttggtgttttagacatcaagtccttgcccatgcctatgtcctgaatggtattgcctaggttttcttctagggtttttatggttttaggtctaacattttaatatttaatccatcttgaattaatttttgtataaggtgtaaggaagggctccagtttcagctttctacatatggctagccagttttcccagcaccatttcttaaatagggaatcgtttccccatttcttgtttttttcaggtttgtcaaagatcagatagctgtagatgtgtggtattatttctgagggctctgttctgttccattggtctctacctctgttttggtaccagtaccatactgttttgggaacctctgctttattatatattgtaagcaaaaatctttatagaaatccctgttttccttttcttattgttaaacaataaaatgtgctaggctttataaccagagaaaaatgggaaggaggtatttcaaggatagcctgatgattatgtttttataaataagatcccaaacagatggaaattaaaccaaatcattcaatgacagagggtgacagtaggtctgaaggcggctatttttatggggagtgttgagggttttgtttttcttaggggagagtggttattagattattgagctaatagagccacattacttgggttcaccactggctcttgaaatgacagtggggaacctttgagcaacstacttagcctttctgtgaytcaatttcctcatctgtaaaataaggtttatacagtatctacttaccaaggttgtgcgaagatcaaatggataatatatgtaaagtaactagtatagttcatggtacatcgtaagtgatatgtaaatgttggctgtcgttgttattgtgcttgttattattattattagctggagtttgtatccctagctggctggccartatgttgtattcagtccctgatgccaaagtgatttatccctaatggaacagagactatttaaactttattgagggacatccaaatctttcactgggctctcaagagagctctccagaagactgttaaaatatagtcagataatatctgctgtggaactcatacaggggagtttaagcttctgccactcagggttcaaacatgagatggccaaaactcctccataagaatgagtttcctgcctttcctgccacagccagggacccaggttctggaccttgctaatgaagcctgggtgatacatggagggataagcagcagcctgataaggagtagaaatgggctgaaaataggaaggtgagagaactctgaggagaagacttatttttttttttcttttaacccttcagttccttccccctttgctctgtcttcttattaccatctgacatcttagggaagcagagctttcaagtaacagctatcttaggacaccaaacaaacagagcaggtggactggctgtcttctgcccttgaagtcatacactagtcaatatcttcagcttagtttgcatttgtggcaataagatvtaagtatattgtgcagacctacaaagtttggcttccaaaatggcgacttcatattttgtaaatttatcaaataaatgatttttcttaatgtaccttaagtagatggaaattkagttgaaatttaaaattttgattttcagaagcttaggtgcaattgtatttctttttttagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgaggtaagtcaggagatctgctgtgtactattttattttctaaataattgatgtttttatttagcatataatttgattaattttaaaatccaatattaaaatttataaagtgatattttgattacttgattaatatactagactaagctaaattaatgtaagacttatctttgatttgccacttgctggtaagtagcaacccaaagtgccacaaaatggtaatcaataaatgctgatgaattaatgaatgaaggaaggaaaagggggacaatttcattaacatactggagaatcctttgatttaaatcttttgattaaaatgagaaaaattttcagctttaaaattggcaaagtaaataattataaaaaatgagtgtgtagtgaaatgttttcttacatgtctagagaaagtctaaattggtagactttctgggaagcagtttgcttgtttttattaagaattttaaatgatttacactaaatacccwacatttaaatttaaagccatttagtctaaaaatttaaaaattgcaaaaatttatttaaaatataatattgaaccaaaaggcaatgattatttaaatacattatgatggatattatagatttcacaaaartcatgtttttgaatgatatatatacatataaaaggctcatgataaggtattaatggttttaaaaagaaacatgttaagtggtataaccagtattatttttgcaattttttaatacattaaaattaattaaatattgactgagagtggagtctgaatcaaatggactaggtttgaatcttgactccaccatttggttattggttacatgacatacaatatataaattatttaacttaccaatgcttccatttttcttccrtgaaattgacatagtagctgcacctgccttataacattactatggaaattaaatgagggattgacttattactcataaaagtaattgaggagccaggcgcrgtggctcatgcctgtaatcccagcacttcgggaggccgagatgggcagatcactagaggtcaggagttccagaccagcctggccaacatggtgaaatgccacctctactaaaaacacaaaaattagctggtcatggtagcactcacctgtaatttcacctactcaggaggctgaggcatgggaatcacttgaactcaggaggtggaggttgcagtgagccaagatcacaccactgcactccagactgggtaatggagtgagacgctgtctcaaaaaagaaaaaaaaaaaaaaaaaaaaaaagcaattgatggaattcaagaaaatgctagtaatgattttctctgggtgatggcattataggtgcctcttattttctcctttcaagttcccatgttttctaaaatacctagaatgaaactattcattttataattcaaaagttattaataataaaaataagatagggtgaattacctcttaaaagactaaaaagctttttttaaaagatggatatcgacattcatttacagcttatactatggattttttctttattcaatatttttaaagaaaagcacatttatcaaatttgctttgtcaaagtagtcraagtcaattcattaagcaacatatcacttctgagagtttagcttactcacaatattacctatttagaacaaagatgaagttcaagaaaaattctatcaacaagagccctgagcaatcaaaatacatggtacagaatccatgcactaaacctaatacaattattttaatgcraaagcctctcaaattgtctctcagtggtattggggttttgttgttgttgttgttgttgctttgagacagagtctcgccctgtcgcccaggctggagtgcaatggcatgatctcggctcactgcaacctccacctcctgtgttcaagcaattctcctgcctcagcctctcgagttgctgggattacaggtgcatgccaccatgcccagctaattttttctatctttaagtagagacggagtttcactatgttggccaggctggtcttgaactcctgacctcgtgatccacccacctcagtctcccaaagtgctgggattacaggcatcagccaccatgcccagtcttstttgttgttttaaaacactctctatgtaattgtgtaagcaggaaacccaaggatcatccctggcttgctccgtatttcttatctcctacatctcacaatcaagtcttctcaattcaccaggcatggtggctcaaactgtcatcccagcactttaggaggctgaggctggaggatcacttaagcccaggagtttgagactagtctgggcaacatagtgagatcccatttctacaaaaaataagagaaaatagctgaagacggtggcatgcacctgttgtcccaactactccagaggctgaggtaggaggatcacttaagcccatgaggtcaacgctgcaatgagccatgatcatgccactgcattccagcctgagtgacagagtgagaccccctctcaaaacaaacaaacaaaagccttatcagtttttctcctaaataccatatgggaggtcagaaaaaagtttgcttacttggattattaaattaataattattaagttttaaatcatatttctttcgatttcccatgcttgtcatactgtcttgcctaataggcctttgccaggtggtacttctgacttgaacacatgcccttctcttctgcctttcacctggctaaaagctgctcattcttgaagggtcagtttagaaatcctgtctctgaaaaggttttggtgactcgcccaaagcaggagccactgctatcctctgttgcacaccctctgtttctcccatcagagcactgactatgctttaygctctcagaggcttcctactcttaccttaagtctacttctatctagcctgagacacctgatttccaaacccagacaggagaagcaccaaattatatagaggctgttacagagagatacatatatggactgaagcagaaattaacaagggatagcctcacagctggaaaggagaatcaaaatatgaaacttaaaactcttttggtattttttaggtagaagctgagagtccttgagagtttcaatattaatagaccacaatatgggaatatcaaagaatggtaactctggactctcaagaaaggcatgcactcttgagaaagacagaaaattatatttaaaataattccataaagcagttaaagtaatatatgattatttattttatgtaattgttctaataaattttacggcacagtcccctggtaatctcaaaatggtcattttggttttagatatgtctaactttctattcccttccttattgaaggatggtaaatgatagcaaatgtagttgtatacatgtaatttataaaagattttggaaatacttagaatgtagaattctctttgctgatttttatgaagtctttgtgtatcataaaactatcattgttacttttatagatgcaaatctactgctttgatgcrgaccgattttcaagttttgaggaagcagtcaaaggaaaagggaagttaagagctttatccattttgtttgaggtaatatatakacactttacactaatgtaattcctttttaagtcacattaaatattgacgtgaaatatcaagacataktttctaacaaagagaggagctcacaagtaaaattaaaactggtggtcattttcaaaaaaagatgacccttgcctggtatttttaaaaggagactcttgtgtttgttaattgggtgaatcttttctagctggggcaaagtgttctattaagtacacagatttgcttatagtacataaaagcatcatattaataattatgtattattatcagtaactatgaatcataaaattttaaaatttacttttcttagtgaaatatgtaagttacctggtttttgtttgctttatttgttttcacctagctataaaaaaagtgtttttggaacttactattttttaatgcacatatttaaaatgraattcattaatcttcacatttttattgaatagttatccaaatgttttattctttttttagaatgtgattcttttttaacaggttgggacagaagaaaatttggatttcaaagcgattattgatggagtcgaaagtgttagtcgttttggtaagctacttggggaactatctttcttcaggattctgctttggatggataagaatgttgacaatacgacaaaagtcacttgttccaaaaggtggaaagtactacatttttraagaggagcaatctctcactttccacacttgataatttatacatttctcaccaaataaataacaatttatcagaaaattttgttacatcaaaagcatgaaacattaatgtaagtaggaaattgaagtttttaaaattcttgaaaataatctaattatatcatgcaattaaagcctatttatctattatgtctctgcattatacatccgttaaagactaattcctaatctgaaaccagctaattttataaatatcatattttaaagtagaaaaggaattgttactcaagttaaaatttattccctggtggtttccttgataaatcctttgctttatcaacatgaggagatgagatttttggaagaaggtcaacacttacatagaagaagatgcaatatgctttgacattgttctgcctgctatctcatggatcttgtaatttgtcacaacaaatgcttttaacaacatgggcagaggagtgtaagcctattaattttactattttatttttattaagcactcacacacaggatcttaatgctgccctgagttaccaataaaatgaggattattcctctctggaagctgcaaaatttgaaatcagaaacaaaactcatgtagatccttttcttgaaagcagaagcctggcctaggattgatttatcattgtcaattacatgtgaggatctgaattgacccaacttttcagaagtcaggaatatgtgaactcctgcagggtagcttttattttttttttttttttagagacacagcacaagatgaagctgttacctccctccatcaacccagattgcaaaattctacattgaatgcgataagtcacatttaattttccccacttgagtcacaaagtagattctatccagactgaaataaaacaacttgtttgaattcctatacttaaaaaaatgtgtaagatatgaattctgaatgttccagaccttgcaccagcctgtggggacaatgaaagagatgttaacactgggttgttaaccctgacttgtgcaactatgggacctttgagactttctcttaaggcctctttactttcccaggtactttactttttgggggtgccttggaaggcactcatacgagcttgagaataaacttgctcatgttctttaaaatttcctttctaatatctactgtctgaaagccattcaggaagatactttgtcagatacactgtgactacatattctctccctttctgagaatatggattccctaacagcattattctgcctatattctggctcttaatttgaaagcagaacagttcttggattagctgaggacggattctagtcctttaccccctctctctctgtctctctacctcacttgtattagtccattttcacactgagagtaagtgatgtgtaaaagaaagagattgaattgactcacagttctgcataggtggagaggcctcaggaatcttacaatcatagtggaaagcaaagggtaagcaaggcatgtattacatggcagcatgagagagagaatgagagtgtgagcaaaggagaaactgcggaacacttataaagccatcaaatctcgtgagaactcactcactatcatgagaacagcatgggggaaactgcccccatgatccaatcacttcccacttggtccctcctcaacacatggggattacaatttggattacaattcaagatgagatttgggcagggacacagagctaaaccatatcaccactatttgtgcaccaacttcctcatttaccaaaaaccaaaatccttcatgcctatccactcattcatctggatacttagtatttcaatatactcagcaaggacaactacccaaaccaaataagttaagtctttctaaagtcaaacgtttccattttgagagttcttgaattaaatccagtctatttctgactctagaaaatcccctactgcccaataaactgaaggctcccccatattggcaatcagacattgctgctggcaaccttgaggatcaaaggtgggacttgtctttaggcagtgattctggaaccacagctaaayccccaaatttggctctgtattcaccatataatgtaagttattaaaaaaaaaacaccttttcaaccattattcagattataagatctatcttactatgctgtgggctggttgctcatttcctgtttcctctctaaaggacaaagcccatttctcattcctcccctcaacccctctttctttctttccctcccatccaccatacctactctatgttaggcattatcctatccatggagtggagagagagagagcatgatgttgcagcaatactgagataatgaattaatattttccaagcagagcccacaaaagacrttagttgcaatctttcgagttgcagggaagagacacatcccaggtaacatcatcagtgattatctgatggaaattctcatcagactgatttatagtgctttcttaatcacaatttcagcccagaaatttctgtactgaaaagtcctcataggcattggtgtgaccccatgctaaatatcattgtcctaagtaataggagctggttttatgtagttaccagcctttctctagtgcttggccctattgtggtttcttcatctttgttcctccccatcttttttcttccaccattagccttctcatggacggatctgattagttggttggttgatcatcattacatgttcaagcaaataatgattgcaaaaatgaatgactgaccccaaatagagcagcactggctctgctgtgcttctctcttgtgttaacaatagtgaggttacttggatgaagcaggtgtttttttctcaagccaacaaaacaaaatgaaaaccacaaacacaaacaaaggaaaacactgtagtgaaattttgttagaagaaaatgtaactgaaaagcacttctgtaatttaaaaatcttgtgatatctagttaccacatccgtaagagagaccaggtgactgctattgaggtccagaggcagaagaatggattccacattggggatagggagaggaaaatgaaaaaaaaaaaatcttcttctgattcttttgcttctttttaaattttttcccctttaatttctttcccaataataggaaaattctctgtctcactctccttactcaggtctcacctctgctttcccttccgggcccctggctctcctggggtcaattcatttccacctaacttagcagcgagtcaatttctggctctttacctaattagtattctcaacacacacatttttcatgaaatatttgtaagataaatttagtcttcagtgggaaaaggaacaattacagtccacttgtcagttaaggaggtaatttaactacaacacttttctagtattgaaaacataaatctaaaaaacattcacagattaaaaaaaaatattcttcttagttcctgagaacttgaatctaatctgaattctgatcatgttatcttggcattggagaagaggaggacatacttttagaagttactaatgaatccgttaaatcaaagaaaacttgaactttctaatggattaaaactacatgtaggacatattgacgtgactatcaattcagttaagaaaaggtttttatttctaagattcagttgttaattcagactgaagcagttgtctgtaactttagttaataacagtactccttttcccttcagaagtttctgttacagaaaagttaacatttactaatttaacttttaaataacttatttttctttgaggctttctgagtatgttcagtcttcatagagtttacagctggaatagacttttaagatcagatagtctagtcatttcgtattctaatgtggaaagtgtggttaagaaagactaggccgggcgtggtgkctcacgcctgtgatcccagcactttgggaggccgaggcgggcggatcacgaggtcaggagatcgagaccatcttggctaacacrgtgaaaccccgtctctactaaaaacacaaaaaattagccaggcgtggtggcaggcgcctatagtcccagctactcgggaggctgaggcaggagaatggcgtgaaccctggggggcggagcctgcagtgagccgagatagcgccactgcactccagcctgggcggcagcgagactccgtctcaaaaaaaaaaaaaagaaagaaaagaaagactaaaaccttgaaaaggcttcactttacttgggattttctacactagcctactaccctgcatgtttgcatcacctggggatgctttttaaaaatctagatgmccaggcctgaccactagagatcttaatgcaaatggtctagcgtggggcctgaggcattggtatttttctaaaactccctggattattcacataaggattaacaccactgctctacactccgccacctcacttagactacacggattggcttcagggactatttcttaatggccttaatctcatagagagggcagaggacttgcactgggctgggtagttcaggagataggaaaacaaattagacacagatctcactggtaagtagattgctgcctacatgagtgagggctggttcacaaatagctaaatgaccaaggtattgctattggtaagtgctattggacagatacaaatgagactattcaaggagacagatatatttggattgtttcagggtttgaaggccagatggcccacctaagaaaactctaccagtttttggatagaaattctataatctgtatacaagtttatatataagaataracccatatttattggtgtgtgtgtgtgtgtgtgtgtgyrcacacacaaacacatctgtgtatattgtatcaaaaatatttttttccactctttggctttccttttaactctcttaatgactattgatgaatagatcttgattgtcatatactaaattttatcatttttccttttataagtaatattttttgtgtgccatttcagaaacctcaacctaccattaggttatgatgataattttttaatgttttcatttaaaagcattatgaatatgttcatttaaatctgcaatcagtttagaactgatttgtgcttatgatgtgaagtagggaatcaagattcacttttttccatgaggatattcaattgatatagcactgtttattgaaaagaccatccattccacattccataataattttttctatcatagatcaaatgatcatatttttctcttttattttctcttccattgttctcttcatcgatctttgcacaaatacctcactatcataatttctacagctttatatgtaacagtatgacagctcttcctatctggtagtgaaagttttccagctttattatttttcaagattgtcttaacttttctttggatttttattgagattttagaatcaatatgtcaattacacacacaaccttctgggattttaattaggatttcattgaatctatgaatcaatttggggaaaatcaacaccttcacaatactgactcttccaacccatgaacataatctttctgccattttaatatttatttaattctctccagaatgttttgtaattttcagtgtagatattctacacattatttgttagatttatttgtatttgataatgttttcctattttaaatcatattgctttaaattttattttctgttgtttgatgctggtacacagaaatacaattgatttttgtatattgatctacgtgcagtgactttgctaatttcacttattatttctcattctctgtagatgattttctttctttcttttttttttgagatgcagtctcgctctgtcacccaggctggagtgcggtggcgccatcttggctcactgcaacctccgcctcccaggttcaagcgactcactctcctgcctcagactcttgagtagctggaactacagacacgtgccaccatgcccagctaattttttgtatttttagcagagatggggtttcaccgtgttagccaggatggtctcgaactcctgacttcgtgatccacccaccttggcttctttacaggcgtgagccaccacgcccggcctgtaaataattttcaatgttttacatgcacaatcatgttatttgcacaytgtgatggtattattttttcctatacaatcttaagattttcgtttcttttttctttattgcactggctcagtcttccaattcaatgttaaatagaagtggtgatggcaggaaatcctggtgtcattcttgatctctaggggaaacactttcaataagtcattcttaaatatgatgactagtacaggctttgatgatcatcttcaccagaataaggttgtgtttttattttccatgaactggtattgagtcttatgaaatgatataactatatctattgagatgatcatctgatttctgagtatttttatatgtaaaatattctgttcaccatcttgatgtaaagataagtcatctaacactgtatagtgacatgtgtaatacaatttggggcatgccagctttattaccatttaaaaatatatctaaaatgtttcaaaatctcagttttgattaaatacataacaaagcatgtgtctctgtttcatagaagttttgaacagctaagttccagtgttgagattccagctgagatgtatattattcctttttagggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccaggtaatcttagaaattcaaacaaatcaagtaattcaaagccatttaaaaaacattatgttctaagtttgctataaaatatccattttaaagcatttaccaatgcctttgaagcagatatgttaaattatttgatctttttttcagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcaggtatgtatttaaatataatcttctacaactctcatagatgcagtgttataggaggtaattttggtaaactgacaaatatagaggacttagagctttagaaatgttttaattattaattttgtagctttagataagctgtctaattttctgaatatcagataccacatctataaaatggcaactaaaaaaatctattcttcccataagaataaccccattttacagatgagaaaaactgagatttaataaggaaaatcatttttccagaatacacagtaataagtagcaaagcaaagtacacacctccaagttcactttctggtatttgcctgggctgagaggtatgagaaaggaatgaataagaggctgaggtgttcagagcttgggagatcatttctggttgggataataaggaaaactttatgggagaaccgcctttgaactgagtcttgacacagtatttgggttttaaagtgctcatctttgtgttggcagcccccaagaaggagcctagcaccttatcagtactgaaaataaatgcactgagttattaatgaataagaagtgaatcttcttcccagtttccttctttggaggaaaagaaatttgctctttttaggtacagccaagggaaatgacaccagaggggtgtctctagaatgccgtctgttttttgaagctgacacagtagttaaaagcatttttaaatgtccagagaacacaatcagatacatctgctgacttgtccttttcagtttttactgaggttgtcacttgttcattaaagaagtcgttgaagtgacctttgcactggaaaggacttctaacctttccaagtagatggacctctttgatatcagtcctgcaatgaattcaatgatttttttttgccatgtataatattaatttaataatcatctgcttttgaagattaggcattaaaacaacaagcttttattgttttaatgtgatatttccaagaatcgtttatcctttaacaaaaaaatagaattcaagacaacagtgatgaatagctatatttactatgacactaaattttaaactaaattgccccaaagtgaggaaatttaattacatttctatcagtagtactaaatactatagcatactgtccagtaaataatagacaatcgattagaaaaaagaaagtggatttaaccatcccctcttcttaaatataatagaccaaattactaattaaataaatatgatttttttgtcacacagttttatcaattctgttttattaaaacccttcactggttctgcatcacttttggaataaagttcaaactgcttgttattgcatggcaggctctgtgtaggtttactagtcttagtgcttaagcctccccaactagcatccttcccttacattgaactccatgaagtcccctgaagatgcaagaccacattcttccaggttgcatttgtacatttggcttccccattgatggcatattcctctccactgtcttcatttccctgcctcctcattcttcaagactcaagttgagcattgcatccactaggaggccatctctgactctgcttctgtccccctaagtctggccctggcaatggccacaggactgcacactcaaggagacaccatacccatagatggtaaatggtgctcctctggaggttgtacgatgtgctcagcttctccagacttcatagcagttaccacattatggtaattgtctatttacttttgtgtctctgccagcaatctctgagccccataatggaagtaaataagtcttttatctctttatctccatggccaaactaaagtaaagctctctttcactaaatattcactgcatggctgaaagactccatttccacataataaaaacatagcaagttatacttaatgggtgcttcctgcactgtttaatgtgtagatctgtatataattctgatttaatgtagaacattgctttcacagttaagtgttaaaggcccaaagtaataatccataataacaaaaacagtaatagctactgtgtattgtgtgactctaccaggcattggaaccagacaatatttgacgtagacctcacttcactcttatgaagttggcctcattgtcttcattttacagtttgggaagctgatattaaatggcttgcccaagtttacacaactagaaaggaatggagtcagtatttgaacccaagtctccctgaatctaaagctttgcaaacttctgtccactgtacttgacatttatacaggaacataatttctgcttacataaaaaactgatgactttaaagacatgaagcttcaaaaaaatagtaatggattttgagtgttttgtttatcctaaggtcaaacacagaaacaacactttcttaactacttggtgttttgggttctagaaatacatgataggacctataaagtaaggaaaataattttcttgaatggagcttgtaggaatygattttattcccttagactatgtgtgtatattgtcacagaatttcacatccctgctgcaatactattatgactgccatagtaataataatttatttatcacctatttgtctgtggtttggttccaaaataaatggcagaactaactagaaaaacagcaactcaaaatagactcactcatttaaattgaagggacttaaatatgcaatacttaaggaaaaactagaaagtttaacaataaaaatgcacatttacaggctgtttttgttgtctacttatcctatatgtgtgccttccccagcttcctcaagaaaatccagtcacaccaactactttgttatgtttgtatttttgactaaatatttatggagtgatggggagaggctacaaaactcagcatctcatcaaaatatctgcctacagcttagacaatattgcttatatagtgttatccgcttatattgtatatccttaggataaataaaagtgctcaaaagacaatcctagtttttattagtgttttgtatctttatggccatcagtttttattctaaaattatgttagcagaaacacatctcttctgcagtctcccttgctgggccttagagtctttgccttcagattgtttgaccctcctctttggtcagttcccctcacagagtctcagctgctaccctcatcccacccaagtcttcacgtcttcttaaggcaggaaaattagctttgtcccaggtccttcaaacttgcctgcccgtgctcatcctaatgagctcagcaatcaaaaaaggccctttttggtagaatgatttattttcttttgggtgtatacccagtaatgggattgctgggtcaaacggtagctctgttttaagttcttgagaaatctccagattgctttccacaatggctggactaatttatattcccaccaacagtgtataagcattcccttttccctgcagcctcactagatgcaatgtttgttggctttttaataatagccattctgaatggtatgagatggtatctcattgtggttttggtttgtatttctccgatgattagtgatggtgagtagtttttcatatgtttcttagcagttgtatgccttcttctaagaagtgacatatgcacttatatgttcattgctgtgctagtcacaatagcaaagatatggaatcaacccatgtgctcagtggtagattaaaaaaatgtagtacatatacactatggaacactacacagtcataaaaaatgaaatcatgtttttttgcagcaagatggatggagctgcaggtcataatcctaagtgaactaatgcagggacagaaaaccaagtacctcatgttctcacttataagtgggagstaaacattaattacacatagacataaacatgggaacagtagacactgtggtgtacgagagagtggagaggtgggtgagttaaaaagtctccctatcaaatataatgctcactagctgagtgatgggatttgtactctaaacctcagcatcttttagtattctcatgtaacaaacctgcatatgtgctcttctatctaaaataaaagttgaagtaaaaataaataaatacataaatattttttaaaaggggcccttcgtttgccaaaacatatccccttctaggggggatcagagatgatacagaactttttttttctggttacatagactaatatgcacatttatgattttaaagtttcaatcattgtcaaaatatatcattttgagacagcaatgaaatagaaaagtcaggtcatgttggttggatgagtctcatccatacagttacatattcagtcgattcttttttggatttaatacaaaccactgtcaaataattaatatgcccttatgcgtatagggcctttctgattcctctttcttctgaaccatcataatccctgacctgcagctgtggcactttgcctttcttgccttgcttcaggggtgtttatgtgcatgccttagtttcttagtagatccctgtctaattgatctcagtgttacctgtaacatctgataaagtacctggcaggtagtaagagccctttgattccttgatgaatggtgaataagtgaatgaattaaaacattggccaaagcttactcatgtctaagcctctggggttaaaaagagcatatgtgttattggcaacaaacacagaagraatgactggctttagatttccagacaggttggagccaagttcttcttgctgaacatcctttaaataatttaaaatttgcaaagccttcagaagaatacagtacagtaggattagcatgtgtgtacagttcatgttcaaaattaaagatcattccaggaaaagaaagattctaattttaaaaagatagtatcagtattatgacagaattgttatgaaatagtttcctctgtgactgaaaaaaatagcaaataatttacattcttcattttgactctgttgatcctctgtaaaattattgtacttaacaataatgaacacctagcatatcaagatttattatrtaataatttttatagatgtccattgtataacagtctgcatttactgaaatcattataaagaagtgagctacttgcttttatttttgcagttaaaaaagaggagaaatgaatctgattagacccacagaaattagttgtttctttcttcacaaactaggacttgctgtttccatcacgagtctttacactcaataagcatttattatcatttgtcctgtgcatagaaatactgtgttcctatgaaagtttttttttttttttttgagttggagtttcactcttgttgcccaggctggagtgcaatggcacgatatcggctcaccgcaacctccgcctcctgggttcgagtgattctcctgcctcagcctcccaagtagctgagattactggcatgcgccaccacacccagctaattttgtatttttagtagagacagggtttcgccatgttagtcaggctggtctygaactcccgaactcaggtgatccgcccacctcggcctcccaaagtgctgggactacaggcatgagccaccacgctccaccgaaagttttttcttaatggatatactatctccttcggaactgaatttgagaataagaattgaggattgtatttatattcagttttgatttttattaaattcaatctgaaaatttttattacatgaamttataaagcgtagaaaatatagataagcacacagaagaaaataaaaataccctgtaattacactacccagagataactattatgaagattttggtaaatatccatccagatctttctctgaaattttttaaaaatgttattatacttcacaaaaaatgagagtataccacatgtctgtttactgattttttttacttcatattatacctttaatacatcattcttaattttatgttgtattccatcatatagttataactgtatattaaaccttaaccagttcctcaattttggaccttcagttcatatattttttgccattataaatatctaacatcctcattttgaccaagaggagaagtaaaagctagcataaaaattgtcaaaatcttgctctcaataaatgcattgtaggaaaatgtatttttagaaatacattataaataatcgcaaaaaccatgtgagatttatatattcatataaactctgtaaggttagagaccaggccttattcattttttgcattcayagcaggcgctcaatagattatttgtgaattaatgcatattttatctgtatttccatttgtatggagagtgccatttattaggaaggcatttctttttggcatcatggaatggacactggytcttctaaggatcacagaatttaatagaaccatctgstcctgaaagagttagtgaaaactgtctttttttttttttttttttttttttttgacagagtctctctttgtcacccaggcttgagcacagtgtatcgatctctgcttactgcagcctctacctcctgggttcaagcgattctcctgcgtcagcctccctagtagctgggactacaggcgcatgctaccacgcccgactaatttttgtattttyagcagagacggggtttcaccatgttggccagactggtctcgaactcctgacctcaggtgatccgcctgccctcacctcccaaagtgctgagattacaggcgtgagccatcgtgcttggccaataaaaactgtttgtttgtttgttttttaaataatgagtactacatgtgaataacagtacaaacatagcaaaagtatgaagtagattaagttcaactgtatscacgccttccaggcatcagatgctttcatgctgccttcttaccaccttacaaggtttttctgctaagaagcrgggacctgctaaagcacaggggggaaaawcagaccttaaagttcagtagacttgattttaaactccagcaccaatacttattagtcatataaaaattgtcaacttacttaaactccccaagcttcagtttcttcacctatagaatggaaaagttaaaaatggtcaccctatagggttgtggtgaggtttaaatgacctaaaatttgcaaagcagtacagtcccttgaatgtaacgtgctactgactcataactagtatcattgtcatgtgtatatatggacagccaagatatcacagtgagtatggtatactattcaagtttttcatgattaargtgttcttaaataattgttgaatagaattatggatgcacttcaaatctcatttgctagcattgtaatatatttaatacaaacttaaaaaaacmaaaacaataaaagataaaatagttgtcaggacagagtagcataaagggagtgtctttgtagcataatattttgacctatgagaaattttgtacaatttcctgaaaaaacgtcataatgaattatacattagtagacttaccttcttgaaggtcagtgggttgttactagcatttgttaargtcacatgtatgtaaacactgtactgcacctatgttttaaaaagtgaaatgaatattatttacttcttggaagattatatactacaaattgaactgttgatgaagtcactctgggtccctaaagactgagtgaaagaggtagaattagaaagacttcttttggctattaatctaaagtgaatatgtaatcattcagaagtacaaaacagggatagatcttttccaattacattcagcatttgtgtcaatgtttacattagttgttttaggatctgctactgcctgaggagaagtcacaacctcattggttaccttctgggtctgtaagtcattcagcttttctctcagcagtcattgtcttactacttttaaaaatgaggctcataaacttcaaataaggaagtggtggacttattagcatgtatttacgaagcacttttggcatgagctgtgttatactgtacagaacttcaaattagtgggaaataactgagtgagacctagtgtagtctcaggtaattatgacattttctctgccactccctaagaatcacctccctgccatttcgtatcaatccatattttactcagaatacctgaagctaagactgcgccttttccctcagggcagattgtgcttcttccaaggcaggctagagaggaacagaagtggaaagaatctcctatctccccttggtcatctgcatcaactttcttgattaacaaagatttgtcacagccaaggaatgcatttgcatttctctgtctcttttctttttttcttcatcattcagtgctttgcttattaatattttagcaccggttccacagatcacatccattcctacgtactaggtgttcactcttcatttaagtaatgagaggatgaatgataaagcacaggactttgtgtcagctaaaagtttaagaagcttataccatttttagtaggaaatgtgtataaatttgaaaagaatttggcctaaatggcagaatttttcataagttttttatacattcctctatcaatggagtgcagaatttagaatctaaaaccactcgttacatctgagagcttactaaatctaagtgtttgaaagctatcacaggaatgagcatcctaaaggctgagacactatcttcttcttctgtatgtctagagtgcctagaaccaagcagatgagagtggaatgccaaaaataagtttttaaagcaagaacatgtatagctccctgataaaggagactacattctcattctttatagtgaggattctttgctcactgctcatgtatggtgcagtgccatttacttgtactctacgtgacttgacgtgggccccagactcacagccagaagcctgcactaaccagtaactaggttctccttcttagccagtgtgccctgaagaatcagtaactatgacccagatcacatgtagacatggaaaggaatcagtatgtgagatataggcctgagggagagaatgaagcttcaacagtttcgaactcctcatgatcaggaaaattatatttttgttactattttactttatagtagcttgtatttgatgtctgagtacatattgatctggaaaaatgttattgattttcaatccagaaaatgtactttacagagtaggtatgcttctaataagataattgggctggccgggtgcggtgactcatgcctgtaatcccagcacttggggaggctgaggtgagaggatcacgaggtcaggagatcgagaccatcctggctaacacggtgaccatcccggctaacacagtgaaacctcatctctactaaaaatacaaaaaaaaaacagccgggcatggtggtggacacctgtaatcccagctgctcgggaggctgaggcaggagaatggtgtgaamccaggaggcggagtttgcagtaaggcgagattgtggcactgcactccaacctggatgacagagcgagactgtctcaaaaaaaaaaaaaaaaaaaaaacacaaaacaaaaaacaaagataattgggctgatttcaataggaaatatatgcaaaacctgggaaatttagtgtctattaatcacttcttctatggtcattccatggtttgaacaccaaatagtgtgtatggaattaactaaattgttatttaaaagattcagctctatcttatagaaaggaaaccctttggcaagatcataaactacatatagaaatataggcttttctgttaataacattctaaagtatgyatgtttttttcaccataagagcctgtgtctccacatctaaaataaaagatttacctgaagcttgatagcatacaactatattgttgattaacaataaacacaggtatttaaaaagtaaatttctaattaaaatataaactcaagctattaaacaaataactaacaaactcttacagatttacaaggaggagaacaaagaagtgaaaacttatgggcaagaaaatataactttctttttggagctctactttatattaatgttgattcataaattttgacacgtctactgattgctactactaaggcgagacaaacatagacatccaaccaaagtcgtttctgctgcttaggcagtagtcctttggatgttttgcaatgaatcctttatttttttcttaagagattgttatgctttgtatgtatgcataaaattaatgcatttcttttttttttttttttttttttttttgagacggagtcttgctctgttgccccggctggagtgcagtggcgcaatctgggctcactgcaagctccgcatcccgggttcacgccattctcctgcctcagcctcccgagtagctgggattacaggcgcccgccaccacgcctggctaattttttgtatttttagtacagacggggtttcaccgtgttagccaaaattaatgcatttccaaacagtttcatcttgaagtgtatagttcactttaaatcattcccattctgtaaaaagtggaattgatttttggaggacgaagtctacaaatgatattgtccagagtcacttccaacttttctaaaagtgaacttgggattcattagaagcaagaacgagcttgttgctccaatgatagaaacgtgaatagctcacttgagacaatttgaaggtcttctgccatctggtggacatcagtagaagtctcactcagtagagtaacatcatgtagtatacacctaaattaaaatatattttcttattctgaattcatgttttttgacaatgaaataatttytcttttatttctaaaggaacaccccaacctaagccctccctaaacaaaaaataacatcaaaggtttgaagtgaaaaataatttctaactgatataaagctatacatgtatttatttgtaaaaggtatatatatatattcatatttcctaaataatttctgtaccactgctagcatactgtacatatgctatgccattgctatcatattgtacatatgctaaaattgtgactactaagtattatatgtaaaatttgtttccatttgtaagaccaattgttagttgtgggtgccctccggtgttcatgaggtgaactgcaaactagcagagacaagtcattttggtcacaatcggcggcagttgttaacatatttttgagtccttgtaattgttgtatcagtgatgactgatttacctaagtctactgcatgctctcattgagtggctttgtaacttcaggtgtcacctgaaaacaagtaagtatattaattaatattcagcctgagagatctttctctccctctgctttgcaaatctggcccatgaagagatatttattactctgcttcgttagtaawatatcataaaatgttatagtttttcttttccaaattagtccaaactatcacattataagtgcattttggaaagtaccagggcactctctgatgggactaaatttggggcatgattcccagcatgggcctgaattcattttaagaagtctctgaatgatttttcataatactactttttcagatgagacaaacaagtctcttaattccctaaaattattttcttaatttacttatgataacaaaatgggatttttgtcagcacgtctgaaaaatactgaaatggcaattttaggttttctttggttttctctggttgggaattttaaattagttcaagkattgtytaataacaaaatgttccgataatagtatgtctttcataattgaaattatcctcatcctgaactgaatatattttcaggtaccaaacaagagaaattaagtcatcatgagcttgcagatattctttgttcatttatttctaaaaatgaatctgtatgccaggtatattcaaaacaatgttctaggcaatatagaactacagagctatggttcttatgtttataatccactagaggagtcaagattcattcaggaaaaatacaatacgaaagtatgcaaataatgcagtaataatgataaaataggcaattgacaatgacagagatcacttcagtagagattaatgtgagtaatgaaggaggtagcatttgaccaagacctttccagaatggaaagctgggatttgaacagatagagttaagaggggtggaaagagtattttagatataggaaatggaataagcaaaagctccacagtgggaaagtgtaactttttactttacattgaaataaaacacaataaaatttttatagaatatgttttatttattcaagtcctcaaggctaagttctatcaacaactgtacttttttctctctgaagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttggtaactatatgatcagttgttttacayagggtaacattataatttaatttccaaggtaagaacttacaaatggttgtatattattttcctccattacttttagactttatgtgaaggtggggtaggctgagtatttttaaatttaaaaaaaaawtttaaattagaagctatactaaattatgtttaaagttacatttaattaaatggatatcataactttgccaacaataacactatagagtagatacatatgacttatgaactggagatcatttagtgtggcctttcttaagatttcagttgtagaatagtgccagaatctcagtgccctgatacattttatattgtgtcttccattacgctatatcagcacaggaaaagtagagtaggggacatacaagtcctctttgttgcaccaaaaaattttcagataacagctgggaagtcatgattgggtcagaactttggggatgtaagaaaacatttcttacaaaaagatccacccctgcctccctccaccagcgcatgcgaataaagtacagattccytttgtggcctgagcatgtcagtattaaactttgctctggtagggaagtgttggccatagattagggtgtagttgacaaaccttcatctggatgtagrtccagaaagtccccactgcaggttaaaggacactggactctgcactcaggcacctagagtcctgcaagtcctgggaacctgcatttaaataaaaatgcactattaattatgtttcatatcatgtggacaaaatggataaaattttagtaaccttttaattcagttgcctggaatatggagacacaatgacctgggaaaatcgtgaaataaatagtaataaaaatgtttatttcataattacgtgaagaagataattctattactgttcttgcatatatattgtcaagaaaaagagataacttagttgttcactttttcacattgctccttgtttgcaaatgccccccatttatttgtctaaaatattaatttttagtttgtagtactaatttatgaatttgatgagttctggctaaaaatgaaacttcctgaaactaaatctgatttttaaaaagcaaaaaaaaaaaaaaagcctagctttccagttcttcataattcacaaataccacaagtttaactaagcaacattgcataaacttttccttaggttaataaaatagaagtattttccacggaccagggagaaaaagttttctaggaaagatacctagtgtgttggtagtcctatgagaataacatttgtataattactaacatctttcttttagggtgctattctcaataatttgctacccaatatgagttatgttcttcagatagtagccatatgcactaatggcttatatggaaaatacagcgaccaactgattgtcgacatgcctactgataatcctggtaagtgccaccagatacatctatatattaactcaataaatgaggttagtttaattactgtatgcattgatgctttctctctatattcttttggccaaaaggcaaagtgattttctcttaagtctggattgccgggtaattttttggggcatgggacccatttctcattcagcaggtctggtgccagacaataagtaaacttatccttaatattggagtttaccatttgtaaaataagagtgactaaacatatttataacattgtaataatcattaaatgaaaattgctatgtaaatgttgagactgttattttggataattaagagttggtttaatttgtatttatttcctcttttcagcccccaaagcattatgtagtaagtgtatacatgatcctaagaccatgtgaggtactttcaaatatctatacaaagcatctcaagagtttgtcttagatctatttttctactttttataatttggttatggggagtggggtgttttcctcttggttgattgcccttactcttcccaaaaataagacaaacaaaagttgtttctacttgtgttttatttgcatgtaccttctctaaatgtatgggaaaatcttttgatcttagagcatatgcaataactgaatcaaatgctgaccatcataatttgacaatttacaagtttacataattaagttagttttcctcttgttagtgtaagcagttttaaataatagaatagacrtgcatatatgtatatatacatatgtataatcacatacatctgcataaatacatacgtaaatatatatattctttggtcatccatattaggagcctactcattgaaacttttacaaattttaatgtaagtgagtggttacaaattatattaattatagcctattttagttttacctatggcaggaaaactgatgtgcacggtttgcattgttgtctaaatgctgtagcagggactttaatccaacatgagcttaaataaagtacttgctcattgatcaccttaccatagctgttcttactagttgactttttaagttaaagattatatgtgagagcatcagatattatagtatgcatcattccaaactacaggctacaaaacttgccaaggtatctcccaacttgatattaacgactaatgaatattactactaccatgatggcaatatcattatttagtatttcttatgacctgcctcatggcctgggtataatcatctttcttattgcctttatttagcattgtttttcaaaatcaggttattttttaatggaatgtgagctctaagtcttatagaaaggcgagtatcaaagtaactgaccatgattttaactatgccatatcacgctacaccattgcatggcaaccatcaccaaagttcctcacaatgagctacccagaaaatgacacctttagccatacaacattgatcatgttggccaacaccatatgtgaattgattgaaatatggcatataaaaaaatctcttctacctttatttatgcattttgagtatgaagtatattgaacacattcacttaattttgttaccttggtttaattatgctactctaatttcgtacctaaaacaatttctcaggagtttgcaaaaaattattacttttacccatttatttttacactgtttcctattttattcgctatgccaaagctttaaactttctgaatttttttgttcttttttattttgsagaaacttattgcatatgaaagaaacagattaaatatgtattttctccataagtgatttctgagtgatcctgttagactgactctatattggcacaaagtataatattcttctatcatttgttgtattttcacatttgtactaaataataaatattattaaaacttaaaatttctatttatttaaaggaccgggacactattgaacgttgtaataatgagatgcttgtttggatacaccattaaatctccatggatgcctcagtctcttaaggcattttgtatagtaatgatgtgttagtaaaagatggtatttgatttgatgttttgatatgctatgcctcttaaaaactaagggttacaaacttaggtagattattccctattatttctaccaaaaattcctgcatcaaaaacctgttcctccaaagtttgggattatcctattttttataaagaaaagattggttctcttaggagttactctttctgatctgaaaggctgcaatggcatttttatccacagatttacaatttagtattgaaattacattgtcttaaatattgtttctttggtaaatatatcccaatgaaagtcttgacaataatactatcttgtggcttggtaaaacagatttggtgcctacaagattagtgaattttattatttgtgtgactaatatagatgtaagtggcttttgagtttgctgcttatttcatggtttttattaataccacttcattctgttaatcatgttattttattagcttggtaactgtaatgtagcctatttaataattctattattatttaggataaactgtttactaaatattgtattgctttttgcttttgttaaaaagaaatgaaaaagataatttataattgctgtcattctttgatagatttcatatatatatatatatatatatatatatatatatatatatatatatatatatatatttgaggtggagtcttgctctgtcacccaggctggaatgcagtggtgcaatcttggcctgctgcaccctccacctcctgggttcaagcgattctcctgcctcagcctcctgagtagctgagattacaggcatgcgccaccacacccagctaattttgtatttttagtagagacggggtttcaccatgtgggccaggctggtctcgaactcctgacctcgtgatccacccacctcagcctcccaaagtgctgggatcacaggcgtgagccaccgcacctggccagatttcaaatatttaaatcagtttccctgaagaaaaactcagtcttccaaatagtgcctttaacttcctaaatgtgataaaactatgcatttaaattaataatttgcttacattattctttgtaccttttaattacacttgtgtacaaaagtatcaccataaactatgctcattaagtattatttcaaattgtcgtttaaaaaaatgtgtaagtttgcgttcagaaattaatttaaatttatcaaggagcctttttaatgttaaaaaggaatgtatattcttttaaaagacttcttagttacatttatgaataaataatttcataaatatatttatcttattgttactaagataattatgtttatttctcatataaagataaagctaattaacatacagctctggagggattatttaagtacatgttttagggccttgataattatatgtgttagatttaaatgcatgatgaattaaatccacagttttcttgttactgtgtgctttcagttgtataacaattgtcttaagtcaccatacatctgtcctcactctacctgtaccatccttcctattagtgttattacattattatatgcagaattatagtttgaagcagttgcggtctacattgcttttatttcgtgcactgtgaaacttggcttatcttcaaacaattaaataagccttgcttgctcacctacatcagtgttgcttttttgtgttatagaaaattaatgtgttcctaatgtgttttttttaatttaacattacatgtgtcccaaaacaaaaccagaatgagtcaacagtttttgttcagttattacaaaaatgtgaattctaagtgttcactcaaaacaaaaaatactgatagttcttcactatctgacttttttctagcctttatggagtctattttgatgaagggagatgattctataagccagtataatttttgaactatttaatatattggtagtgcctgactcaaaccagtggttactaaaatatcagttattacttgtgagaaagcagcaggtttaggggtacccaatatgagagcttgtgcccatcagcagagctaaactttgagttcaggatgttgaattcacagttccagaattatggcttcaaaatctttaggaagatagaaacaatcttccaaattattttatttcaaaattgttatgaagagactcagcaaaagacttctggattctaagaaatagaggtattgaagtattcctgggaatttcagtcagttcaaatgatctcagtccagttggaaaccagaataaagagccttcaaggtggttttataygcagtaatatgaatgtgctaacacttgggggtgctcacccatgagagtgccaaggagacgtgcctaggcctacacatgttttcccagagccaaggaggcccaaagaaaaagtcttgcttttattacagtaaacagcaatccaattataagtcattaatattctttaggggatgtgattggattaaaaccctgtattgtaatttactagaatagaaaccataatccctatagttagttgatgctctggtaaaatgataaaaataagtctaatgcaatacacactaaaaatattaaagaaaaagggaaataaatcctcaatgtgatagttatacatacccttccccaacccttattacgattaaataagaaaattatatttgcccattaaaagtatgaagttaggtggagttagaccattttttaaaaattttgaacaccttcttaggcatgttgaaacaaatggaaaatacttgatatttttgtatagcctcttggcagaggaaaagcctacagtatgtgtaccactaataagtatttgattatgatttgccattatgagcattaaatatttcaacagtctatgaaaaagagtggctacacttcaaattattttcaataaaactaggtattgtctaatgggcttaatttgaagattttttatatgcatgaacttctttagtcatagcttttagaaaatcataaggaaggtcatttgtctgtcacagtttagttgcatctcatttttaaattcaaatgtattaatttgcatggcgattacaaagacacaagtgtttgagatgattgaaatcactttagtttggaaacgtaaagaataaagagcatgaagaacagacagtgaggaaaggatttcataggaagagaaatagaactgggagaccactaatgatcaaaataaaatttccaaagtccttcatggttagttttaacgagaaaaaaagtgagaattaaaagtaagattgtgattgtttctagtgagtactttcctttttaaattacaggagttgtttagggtaagtaattttgaaacagctaagttgtcaagagtatgaactttatctgaatcttcttggaagctaggcatgcttaatagattttacataaattctcattttatggttttcaatatattaatacccagcagtcttggtaaaaaataaacgcaagaaactttgtattggaaaacagacctgggtatgatcaacatttaatgttggttcagttataccttgaaatttctatagagtatgcatttcctttgaggacataaaacatagaacataagcagcattaggatagtgcagagcataaattttggcgatagcctgagattccataaaggcatgggagtttgaagaacatcattataataatgctcaaacctcacagttactttgtctaccattttcctaatgacccaggcagctcagaccaagactaaagaaaaattctctggccgctcagtaacgtggtagagtggctagattccttcttaggagagaaagaaccagcttagtctttcctgacattccctgacaggtcctgttttagaactgagatatatgttgattctgatttgttgggacaaacagacgtgaatgattgtggtcatcagattctttaagtagacagcattagctgagtttccctggggagaatgcacaagattcactctgttagttcttcttgctgacagcaaggctggaacctgctggaaaacactcttcattttacctggtgcagcacccagtatagaaataggtatgaggccagatttgaggagtaaagataattatttgtccctcagtcaaaatagaaacttaaggaagaggttgctaaataagaaaataaattctaccaattctccagaaaatccctggcatttcccyaaccatgcttttatcagccctgctaaggatgaaataactctgtactgatgaaaaattatttgcgtttctttacactcagttttatcagtttcactgacctcctctccgttcttagcttcaatcagacttaggggcaggggaaatggggaagggagtggagtgggaggtagagatcaagatttgggtagagttacatataagctcatgtagtgttgtgttgtagtgttcagtaatgttgaaaactaaaatttggaatttttattgtgagaaagtctgtattttcaaagctgacattaacttttttattctttttaattttttctctttcacccaaaggtaaatccacaaaggccgaaatagttgaataaaaactttaataattttgtttttaattttgtagaacttgatcttttccctgaattaattggaactgaagaaataatcaaggtatcatagccatttttatattcaaatgttttaatattaaatggtctattttgaattgttgcttgggtgttaggtattgccacatgaatagaagttgtgtgtatgattcactgtttgtggggttagttgctaagctttatatatagatagtcacataatttatatacatgattctcttatgaagaagttgaaagatgttttgattggtatagtactaaaaaacaagaaatataaatggtgatgaagaaaaaaacaatgaactttaaaaataattatagctatgcactacagctataaactggaatttttttagtctccaaatttttctgaaaaactaaaattatatttaaccagttcttaacattctacagtttatatataaataaccaacgattgatagattaacgctaaatgtggcccaaaatataaattgtatatatattttttgcccatttaaattgtttattatttaagttgataaatattaatttactcaaagaacattgtgctgacaacaggcacttatactacgagtagtctatactttttaaagataaaatgtataggtatttgagactataaattttaacattattttatttttttaaatagagagaaaatgattgtttaatatcttttatatttcatcatatgccctaatgtgctgttcatcataactgaaattatatattcagttcaggtgctattgttgatgataatacgaatgtgtacatgtgtatagattgtgtaggagctgataaaagtgtgacaactagtgctgttatctagcaataaataacaattaggtctttcataggtataaactatcttgatattttatgtatcttatggctagtctctcttacaagggactattttaccaaaatgaccagtctactttgtaacaggagtttatagatttcagctaagaataactttatttgtatatgtacatacatgctcacatgcatatggagatatatatatatatgtatatatacacacacatacaagcgatcaacagaattaagtcaaaaaagaaattatatttgtgctgagttgttaattcaaataatgggtctgacatactgatgtaagcccttttttcagtaattggtgccatgtattaaatgatattctgtttaagttctgtcttttatataagtattacacatcacagactttttagaaaggaccaaggaacaatcaattatttttcatagtaattcccattaccatgattcacgatccatgcttagttactttagttacaagatccatgtttagttatttttcttctctattgccattaaccctaaggcaacttttaccataagcctacaaaagttatttaaaatcttccaatgttaattactagtaaatttctacataaaactataatattgtatttagtataatatttagctgtgtgaataggctacacatgtgactttatatgcattttaaaatattttccattttttaatggacatataatacttctacatatttatgaggtatatagtgatcaaatcagagtagtttgcatatccattatctcaaacatttaccatttttctgtgttggaaacatttgagatccttttttctacctatctgaaaatatatattattgctaactgtagtcatcctatagtgctatcaaacactagaacttattattcctatctagctgtaattttgtatcatttaaccaatctctgcctgtcgccccctcgccactacatttctcagcctctaataaccactattctacactctacttctattagatcaacttttttagcttccacataagagtgagaacatgcagtatttatctttctgttcctggcttattccacttacataatggaggtatatctttatttttgtcatacactctacaatagagatacctaaagctattcctgtcatggtgcctctggtcttgccatgtacatatatgacaaacacaagcagatcttcctgttagagaagaatgtgaagatatgtgagcaggctggcttgttgtagtcagagaaaagttcctagataggaggaaaaaaaaagcctcagtgcatcagcccaggtctcaacaggaaacagatgccacactcaagtggagtcatggaggttaatttaatcaaaaaggatgattcacaggtgtgggaagtcttaatgcaaacaaacaaggggtggcattgtacatttggtatgaattatatcagggactcgttgttacatctaaactgaaaggcaagagggcaaggagaaggtgcagagagaatggcacagcagatgctgtggcctctgtaatgagacagcaccatcctgtggtgaccagttaggtaaggaacctcccaaggaataaccacattatctggccacccrcctagaatgaatggagacaggtggagagaggctgtggaaagcaaaatgagaatatacaacacactgaggaaggagtcacctgagaaagcagagtagaattaaaaatcaatgtcattacttgttggtagaaggctatgatctagaggaaaatgaggaggagaaagaattcttatgacattaggcttatttggtttgtggggctttacccatggtggtagtacccaaagaaacagcagctctaattctttgagctggaagaatccttggcactgccaagggggagggaaccagctaccaccacacagatggggatttaaaataaaggatacaggagcagtgattggtaagcttggcttggtaaattggtagtagttcttgctattgaaattaactattgtattaataatatattgtcaaatcgaaagagacccatgtcacaatatgtcttcctggagcatgattatgagatgggatgaaaacacttcttaaccaatccactattcacttcctttgcttcatgcaggaatgaatgacaggctggaaaatgcatggaatatattcataatgacttttaatccctgaatatagaaataaagagtttgaaggatatttcttagatcctctccaaacagaaatgtatgactttgcaagacaaagtatctgtagcatgatcatggctttacactaacttttaaaaatgaagttgtgaaggataacatatgacacagatcaaaactacagtggaagagtcacaataactctataaagaaattgtaggaaagagtatttgttaaaatatttgtagtcagatatgaataaagtaatcatagggtatgaatgatatgttcttcttaaaatgttgacatagccaatgtgaccttacagcgatcaacaagatatggtagggtaggattaatgaaggtctaatcaccctcactgggttctgagaggttctgaacctcataaagtttatagaacgcatatgtatctgatgtgtgcatagttttttcccaactatgtaataagaagaggtgtgtagcattatgttacaataaaaattttatgaaaatttacattgcttataggaggatatgataaaggatgtttatgtggaaatataagcaaagagaaagaaatgtaatattattgtggaagtcaatagacattgttagatcatatagagaaaatggatgacatatctttggggaacttttgctgtgaaggagagacgagaagtagaatgataactagaaggtgaattagaggttttcctttgtgtttcctttaaataagagagatcagagttgatttaagctgatgagaattatctgtttgagaatttgagaaaacaaatcagaaacacaaaatagactgaactactcaattatgttcaattcccaggttcatgatagggactagatctaaaacacagaagtgcgaattagctttagaaaggaaggaaaacaactctttagttataacaggacaggaggggcagagataacttggttggtccctgtttttatgttaagaagaagtgtgtctttggtggcttctattttccctgaaaacaggaaggccatctgctgagaatgggaggaaaggataggaaaatgaaggtttgacagagttttggtagagagaaggagtgtggagtgataccagaaaactaggcaaatatttaggtttgcaaaaacaaggaagagtttagaaactccacactgccaagcttaacattgatccccagcaaaactctgcatcacattataaaacaaatatttatgagaacttctaaggaaagaagagataattggcaccaaccaattttccctaaaagcaagtcaagrcaaattattctcatttccttttgcattaagtttttaggtttgtagattataggaatattttatttaggaaattatttgggaaaatctctcaggtggtccttgtgaacaaggtatcacacagaatgtaaaacttcataaagaatactgactacttgtaaggaaatttttcaagggaatctgagagagtagccatttttagcactcaatataattcagatcaagtgcactaacttcctaaagttgtcacttatgcttcagaagatactcaygaccagccaaataattaagctgtaaataatgaggcagccattaagcttggaatcgtgtgtttcatacagtgcagatttccgtgtgtatgacacatgctcatgagcacacacagcttaagattcagattctttctactgatactggtcaagttctcaatggctgtactcagtaatttttttcttttaaggaacatggccttaaaatatctaatagatgatcaaataaatgacaattctaacaagctgttgggtacaaagatactgacaaaatcatgtcccacatgaactaaaaaaaaaaaaaaacttgataactttggcaattgagttttctaagtatataattagatataatatacccagttttatgtatatatacgtatatgtatatatatacatatattgaatcttccatgcaatgaagattatgcttaaagcataggtcttggttaacttctagctagaagactagacgtctcctcctgggtcattgcatggaagattcagcctcctgaatggtgattctaagggaaacacaaaattaaaaaactaggagtagaatcatatattgacaagttgcctttgaaatatctgcctaagtcttaagtggaaaatattaaaaaacaaaaggaaaagaaaaccaaacacctcttttagttctaaatcttccccttattatgaccttaaaattatgatttgctctaaatagatataattaaatattctgaatgttcaactactttggtctttaaaatagtttcatcgccaattcttattacaataagctaatggctatttaccttgatgcctgatgaacaaagaaatataaaaacaataaaataaatgccatgttaaataacactgtcaataaataactacagtgtgtcttccttttaaatatgtggtatctattcatttaaccacttctttccatagcattaaaataaaggcggccataaattaggtgttttcattacgtttaattactcccctgtagagcggatggtaaaggttgtaggttagaggtatgcattgtacagaatggtgttttatgaggatgagaagttcccaagataccacaagtgatgattggcagtgtaagatatgaagattttctttttctcttatttccttatgactcattaaatcttgtttgcttttcaaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagayctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtgsctgggggtgatttgctattagagcccagccttgctcagtattctgatgwgctgwccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcarctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactgrtaaggtatttgctggtattccaacagttgcttctgatacrtttgtatctactgatcattctgttcctataggaaatgggcatgttgccrttacagctgtttctccccacagaratggttctgtaacctcaacaaagttgctgtttccttctaaggcaacttctgagctgagtcatagtgccaaatctgatgccggtttagtgggtggtggtgaagatggtgacactgatgatgatgrdgatgatgatgatgacagagrtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaackcagaagtgttccacgtttcagaggcaggttagttacggatcagaaggacagattgaggtgtggtggtttgcttgctctaaaagtaaaatgaaaattatagaaagatagaaatttggtaaaatggtacatcatcatttttaaaatcaaaacattcaacaaatcagtctccagtttctgaagtataattttatttattatttcaaacaattatttaacacattttggtttttaatttaattctctccaaaatagacaaaacaatttttatttattgtcaatatttcatactctacaggatgtcttttatgggtgggggcaattctgtttgcataatacatttttagtacactgcttttaaagcaagatcagagtatgctattttagatgattttaattttcatacttttgttctaaaataagttgtaaactaattctatttaattataaaatgaattattaaatctgagagtaatgtgacataagcacttctctctgacacacccctgtagaaaggaattagttaatttccacattcatatcagcttggggagctttatttattattattatttaattaattaattaattaattttgagacggagtctcgctctgtcgcccaggctggagtgcagtggtgcaatctcggcttactacaagctccgcctcccaggttcacgccattctcctgcctcagcctcccgagtagctgagactacaggcgcccaccaccacgccaggctaattttgtgtatttttagtaaagacggggtttcaccatgttagccaggatggtcttgatctcctgacctcgtgatccacccgcctcggcctcccaaaatgttgggattacaggcgtgagccactgcaccaggccagggaggtatttatgtatttatttatttatttagttttattactaagttttgagagttaataatgaagttaaaaaaaattttaatttttttgtctttctttatcttaatgttgcctaaagagggcagtgtaaaccatcaaaatacattttactttatgcctgctgttacacacttttttaagttaaataatgggcattaatatgtacagtatgtataggtattgtatcacaagatgtaaaacactaaacatttttctgtagaaatgaatttcatttgtgaatgtattttatgcaaattagcttactgaccagatgtttcttagagcagattatgtgcagtgtttataatacagatgtctgctttaaatgccaatggaaagaagagggaagttcaatcctattaagtatagaaaagtaatactttcattgaattggtcataagaattttataatttgcttttattaaatgtgaacgtatcttaaagtttaataatgaaactatttaaatcttaacatcaagttaaatgataggctaatgtaacaaaatgcactcattgtataaaagtgaatatttgtaatccagaacatagacatcagtctcattagaatatttttcctctttgcgatttcatctttttaattagttgtatattttttcttcagtgcagcagcaattaaaagtttgtacattttgatagaaaactttttctgtattctgaattgatacctatttaacattgcattttaaacacttaaatgctgatatgtgagaatgaataatgaatccataggtcactatagtcattagtgctgtcatatatatgaactgttatctgttctcaattatagtagctgctttttagttttcattagatttatgttaaaagaaaatatcaggaatccatctatctgtcttaccaggtagtgacattgatacgttcttgctagactatgctattatagaaggatatatataatgagatgctaaacctaaaattrttgactaaagcttagcaartttctcttcagtgcactaattagttttatttaattatcaagagtgtgttctcccactaattaggataaaacaatatgaatatgacatccaacattatcaagtaacataattagtgaagtaaataagatcaaacaagattaggggaaaattctggcctatttttaaaactgtatctataaaatcatatgtaatctgtcttatccaataattgaatatatccctttatcaaatgcatgcagactagctctgaaacttaagattttatggtgtatttctagaatgcagaacaatttacaggatgtgttctttaaaatactatagataaggcaaatattagtatccacaatttataaatgagtacactgacacccaaagatactagattatttgatccaggtcacatgagtaaatacaaaactgagcctggaaatgtctatctcttaaagattatgctttcatgttaggggccaattaaataaatgtaatgcttaaattgtaataccaaaattatactatcttattctcaaaacatcttttaaaatgttaatcttagttttttatttcttaattacctattaattaaatattttaatttaggtaactcatatatactactgagccatctcaaggagatattttagtctcaaataaataaaaataaaatcagtaaaattaattcctcattatagtacacaaagcaaccaactgattgtctgtgctttcataagatatcctattttgtgtaaaagagctaggtttcatgccatagtttgatcattctgactccttaattaaaggatttaagatcaaatatcccagagcacttttgagaaaagtttatacacaagactatatgtgtgtgcatgtgtgtatacagtgtctgtatataaatatgtgtatatggtatatttacatatataatgcattatatatcttacatatatgacatatatgataggacatatctcatatatatgtatgctatacatatataaatgaaatatgtaattatatatatatatacccatatacatgttgctttgaaaatttgtggctattgaagacctgcataattatataagcttacttcgtacatatattaatctacatcactggttctcaaactttaacatagatcaaaatcaactggaggactcgtcaaaacacaaattgctgacccttacacacagagtttctggttcagaagattttgtatggtttgagcgaagcctaaaatttgcatttctaagttatgatgatgttgatgctgctattctggggatcaaacgtcaagaaaatctgatatagataataatattaaccaccatttgtactaaatgaggtaccaaggactttgctaagtgaatgttttcatttattactgacacacttactttccatctaggtaacaatagttacaatagaaaaaactgtgaagacaaccatgtataaaataagatgtttttctaaattttataaggaaatgctcattgcattcaccatcaggttatttaggtgactagatgattctaaatgagtctccacaaaataatggccagagcttaggattaacattttaaaaaatggagtcttgggcttttctcacaagaatattagctacwactcagggctgagttggcttagaacattttcactttttatacagttttatgatttttaatcacacctttgaattccatttttcctagtaaatgcatttatagttataagaccaaacatcttgggaagtgtgtgtgccatttatattcctgtgatacattacatttatttatttatttatttatttatttatttatttatttatttatttattttgagatagagtctcactctgttgcccaggctgtagtgcagtggcgtgatctcagctcactgcaacctctacttccygggttcaggccattctcctgactcagcttcccaagtagctgggattacaagtgtgcaccaccacgcctggctaatttttktattttttattttttttagtagagatggggtttcaccatgttggccaggctggtcttgaactcctgacctcaagtgatccgcctgcctcagcctctcaaagtgctgggattacaggcatgagccaccacgcccagcctgatacattccctttattaatggattaaattcctgtccctttctgctatcacccttgatcaacagaagaaagctattattttaaatcttaagttctctccaattagatatattttaatgctatatatgtgcacttatattagtctcaattttcttaaatacatatttaagttaagtgaagtttctctgtctcctattacttaagcatcagaagtgccaagtgcataagaaggcatgtagattttgatgggaaactcaaatgtggttctttcagaatgtctgcaggtagatataagggctttttgtagcactgtcagcatgctgtaatgttagaaaccgttctcatgctcagtcatcttggtttcccactgaacacacctcaaagcaaagaggaaggattgttattggccacaaacactcactgttctgaaactctttttttaacaacttggaaggtaatctctagttaaagtgattttcaaagtgctagtacagtaatgtacctgactggcccccaaaataatcatgtgtcatcttttaaaattaactcaaggaccaaattcggatttttaattatttacacttgcatatttcagaagaatttcttagatctacatattcctccaattcacctgaaattgcatttttttttttttgtagaataaaacaaygggtaagaagaacattcaaaataacatttaaaaccaatctatatttaaaattgaaatcgattactggattgaaaggttatcctaatataagaagagttatcccaagatttttttcttcatgaaattattaattgcttctaactatttacctaatgcagggttaaaaataatcctatttaaatttattttagaaaattaatatatatggtgattcagtaagtagcgctgtttttcctgaccattctattttaaatcagtagtgatttttaaattacactactttgatttttcttatttagcaaggcttttcaaggcaatattatgcttacctgttgccaaggcacccctatctgggtgccaatctctgctgggatgttgtagttcttcttgtctaatagcctgccttacattttaaactttgttttaattaaattggcttataattgtagacattctttgcatcaaagagtcaaaattttaaaggtaagtaacagcaatgaaggttgcaattaatcagttgaaaaatgctgtgacttttccttcaccttaaatatcaattctctcaattttctctgactacagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggtaagttgagtatttgttttggaaaatttaattcataaaactcagattttgcccatatttcatctgaaaggtcttcaaagcatattcaaaatgtattttacctgagagctgccattaatttattcaaggtaaatttgtgaatccaaaggcacaataatgaaggagttaattgttcttcatacatcaattaaagataaaatggagaaacttttacccgttactatttaacacagtattttgacagttgtactttcatgttaatctaattaatagatatcatcatagcatttaacataagtctaagcttctcgttagttgttataattccaaaaattaagaaaacattttttatataataacaagtattgtttttcaatgacagaagagtttgtacaagatgtgtattaactgcacatactgataaaaatgataacctgtgcataaaagtaaaatcaagcaattaaactataaatataattagagactacagctaatgactatcttaagatgcacaggcatttaagatacatataatttgctttggggatgaaatatagcttcgctgtcaataatctattaagtccctaaagacaagaataattgtacccatcataaaatttccatcctgtggaaagcagaacacacagcaaattagtgtatttatgaggaacataggtcagtataactgtgtctgttagaaaacaaaggctttatgatgatataaggaatcatatgtgtaaaccaagaaagggcatagcatagtacttttataaagtatagcatacttttattttaaaaaagaattttgttcagaagatacataatttttttgtttagcaacatcattctgtaactttgtatcagcactctttatgtgttctctcaaaatatattctcgtgtttttttctgaaatatttaccattgttattgattgtttcccacatacctagtactgtgttaaccatcaggaaatatcaaaaatgaacaaatgaatgaaaaaagagtcagtgatttgaagaaatatatgcttattgagggggaagaatttgttataaaaatgtataaaatattacacaaaagtgtatgcgtagcagttgaaatctagtgctaaaagtagtcagagaacaaagaagcttggtaggccagaatgctcagggcaagtgtaaactaaaatgtaggactcaagctctgtgggagtcagaaaggaaaggaaaagggcattccaggcagggacacagcaggtgcaaagatcggsaagtagaaatgagctgtcttttgagtaaaagctattggatgtttcggacacagtgaggtctggagcatgtattaatagttgcatgtagttggacattggttggctagggtagaatgtcttcatgatcaactgtatttcatatctgacttcctttactagaacagagtagactgcacactatggagaacagatcatgcttttgttaccccacatgggtcaggagtctattttgttataataagaaacaaacaaacctggtttctttagtctgtatcccggtgattccaataattgccaaagattctttttcyttttttgctaaagggttcatgcttagcagagtgctttgaacmtaatccataatccataaatgtgtgttcaacaaaaataaatattgcttttctccccgttccccactgaacttgttgaccaaattttttaccacattgatatgtgtattcagattacaggtttctatctaatctgattttccctaccaaactacctttttaattaatgggagtcagtgttaagaattgaaaataagatggagaatatgaccaattctgcttcatagtaaatagtgctagtacaaagttccaataaagatgtcagatggtttataattataagattgaaattcgtttcttaatctgtgttacttttcaagtatattttctgaaaatttggaaatcagtatcttatttaatacaatttgatatttcatggaaaattaaaatttagagaggtttctatcttctattaataatgtgtcatttcatctgcattatatggggaaaagataaaattaccagtcaaaaatatattaatttgaccttcaataagatatttcttttttcttcacaaataacactttaggtaccttgaatgcagagtgtcatagtgtaaaatatatatgagtattttggccaggcacagtggctcacacctgtaatcccagcaatttgcaaaggtgaagtaagtagatcacttgaggccgtgagtttgagaccagcccaggaaacatagtgagacctccatctctacaaaaacaataaaaataaacaatttagctgggcatggtagggcatgtcatactcccagcttcccaggaggctgaggctggaggatcacttgagcccaggagtcaaggttacagtgagctgtgattatgccactgcactccagcctgggcgacaaagtaagacactgtctcaaaaaaaaaatcactttgatggttttatgtatatgttttatatctattaaatgttctgataaaaattgtcaatctttacttattttgaaatgttaagtagtgttagatatctgacctactaacatctgtttgaagttaattcactaaaaaatataaattttcatatcatcatatgctaggggtattatgtgctgaatcacaagatgatagttttagttaattcttcaaggtttatgtgaattattcaaattccagtgaagctacatttgtaaacaatatgatttcactagccaatatataaacattttagacctttgtaaaagctacagcttgagaaaaggtttaaaaatctaatgtcgtaccaataacagtcctaatggtaatgaagtccttaagaatttttccaagtttatatatttaaacttttttaaacagcttaattaggtaatattgaaatatcataaaactcacctttttaaagtgtatgattcaatggtttttaaagtgttctactatttccataatgactaatgatgttaagtgttttttcatgtgcttgttggacagttgtatatctttttttgataaatgtgtattcaaatcctttgctgcctattttttaattgggttatttgtctttctattattgagttgtggttttgtttgtttgttttgttttaaggagcagagagtttaataggtaagaaagatgggagaaggcagaaggaagaagctccccgtacagagacagagggagggggcctccaaagctgaaagagsagaacctgagttgtgtgtttttatatattctagatacaagtcccttatcagatatctgatttgcaattattttttcccattctgtgagttatcttctcactttcatgatggtatcttttttaaagtagaaaagtttttaattttgatgaggccaaattcatctattttttctcttattgcttgcaccttcagtatcatatctaagaaggcattgcctaacccagcaccacatggatttactcctagatttttgtctaagaatttaacaaaattaaaggactcatgcttcccagttgcaaaactttaattgaaagctacaggaatcaagagagtctggtactgccataagaatagacatatagatcaatggaatcgaactgagaacccagaaatcttatgtttacgatcagtggattttagacaaggatccaaagacttttcaatgggcaaagaatagtccttccaacagatggtgctaggacaattgaatattcacatacaaaaagtcaaattaaacctttttctaacactatacacaaaaatgaactcatagggaccatagacatcagtgtaagaactataaaattcttagaagaaaatatttaagtatgtttctaacctattttaatgagaaattaatctcaaagttttataataaatctgctatttcacctaatttacctaactcaagatattccccttattttttgtataaactttcagaggaagcagattttagccaaaagacagaacaaattcaaagtgagaaaatccagatctctttcctagttctgcccggcatttgctatatggccttgggcatgtcaattacccacctaggacttggtttctcctgtttaccatttgggtaggttcactagatcatctttaagattgtagccagcgaggcatggtggctcatgcctgtaatcccaaaactttgggatttatatatatatataattwtatatataattatatatatgtataattttatatataattatatatatataattttatatataattatatatattatatgtataattttatatataattatatatattatatgtataattttatatataattatatatattatatgtataattttatatataattatatatattatatgtataattttatatataattttatatattatatgtataattttatatataattatatatattatatgtataattttatatataattatatatataatgtataattttatatataatatatattatatgtataattttatatataattatatattatatgtataattttatatataattatatatatataaaaaaaaaaaagattgtagccagacccaggaatagaataatacacatttctaggttttcattataaatactgtgatgaaaaggcgtaaaccaaataatcagattaccattgattgataggacctatgtctacaagtttaagacagtcatcacttttttcatcatgcctgatggataattagcaggtgacgtagttatsaacacttagcacatagacgtgaagacattcactgcttatactgaacagatggactacagatactgaatcttgtcatacattaaataatatgccttgaaatcattttccagatgttttatggtataatttacatgggccataccataagtttctaagatgcaaaaatgacttcaacagggaagattttcaaaagtttttttttttttaaggcaaatttttgaaagcttttttaagagttggaacctaaaaagtaccaaaggtatacccaaccaaatggcacactatcaaaagcaatatagaaaaggacttcacataaacacaattgttttggctgggggtagggagatgaaaagcaatatgaattctctcttgatcttaaacttgaatttgtggatcattgaagatgtctactaacccagaatggaggtcttctggtaccagattgccttttaagtgtagtgtcacttgctatataaaactgcactacaaagtatacctaaccaatatgcaaatgaccttcatccataatttagcctatactattttaattttttttttttacttacaagctttttggtattatttataaggtcttttagggaaattaatgccaaatagggttattgggctacttattttctagaaccaacaaagatttgattacagatttgtttatttgtttgtgacaagagtagaattggtgtttacccacactactgtgaacactagcaacatattcaacctcaatgccaacatgttttaatttaccattttatattctatgagatgctgccttcttcccattcagtcrtagttattggtacatcctctatcgatccatctgcccatccagccacccattcrtccatccttctctacctatatatcttatctctccttccaaaatgttttgagatttcaagttatcccaattgaggctaaggtaggtaagggaatccaggatgcagctgaacaacatatgattggtgggatttacttgctattagaaatccatctaatcattcaacaaatattgaacacctattctactcctggcacagtattaagagttgggtttacataaaatcaagagatacggccccatcttttaaaaatgtaataaagatataagcacaaaacaaatataatacaaaacaattacactaaccaccaattaagaaaaatacttaaaataaataatgtagaataatgtccaggaaatgaagattactcttagattgattaggtgtatttttcaaaacagtcttttctttttttttcttttttttttttttttgagacagagtttcactgctgttgcccaggctggagtgcaatggtgcgatctcagctcaccgcaacctccacctccctggttcaagcaattcttctgcctcagcctcttgagtagcttggattacaggcatgtgccaccatgcccggctaattttttgtatttttagtagagacagggtttctccatgttggtcagactggtcttgaactcccgacctctggtgatctgcctgcctaggcctcccaaagtgctgggattacaggcatgagccaccacgcccagccaaaacagtctttatgtaggcttttgtgaatagaaatttgggttaggtgcagtggaaaaggagaagctgtggtgctaaaggctgattaggaaatgaaaggccatttcacagagaagatacctctgagctgtcttgaaagaaggcagtgtttgtctggcatattggccagtgagatattttggttagaagtagaggaatgtttaaagcagaatagataaatactgagtcaggagagaaaaggcaggtttatttatctacaatgtgattatattgttagagtataaacttcaataagaaaagtctaacagggtgtggaccacagacaggtagggtttaagtattgaaaagccttggatattataatctaaatatctgtaaaatatataactagaatatatgggcaaaagtaaaagggggatagatatgaacccgttagagctgttaacagtggatcaagaagacctattctttgagtaccatttgtaaatacttagaagggaatgagttttgagttagtagaagaaaaaataaaatctaggaaataaggaggattcaaaaggagtgatctccttctcactgaaggtattcaaactggaccttcttaaccataggttagagatgctgttgaagggattcttgtatcagctgtgatactgcactagctttttaaaggcattttacaacgttaagattcgttgaaatattttttaaaacatttcaccagcttgtataactgtattttggagaaatcaaagggattttaattctgtgaccttaaaagcatgtatcaagtccagtgtttccatatcaatatgtcagaatatgctccattcatagttgcacagataagccaaactttctgtatagtttctgccacaatctggtttcatttctgctcatgtgggccttctgtaggatagtttctgtggccctcatgtctctcattcctcatcagtctrccatactctccattttccaggatattaacctagttaggagggtccctttgacacttgtttctgtatccactcacctttctcttattcgacctgctctctcttgaagatatttctgtgttctctcaatatatcttctctcaggtgtgattatcaaaggcttatactaccacagtagatgactaattttgctatgtacgtcattgctttaagttttttgtttatttgcttgtgacatcaaggttataagtaaactatataattttacaccactcctacttatagaagttcattcatcagagaaatgcttcggggttacctccaacatgacacacatgctcccgagcactaaagactaacactgcaatgattgagacaaagtagtttgccttgtggggcttatattctgataagaagagaccaattataaacatataaaacaaataaaaacataatagtatttcaaatagtgatgtgccacagagcaaacaaaaaggcaaagagtagtgacttagtgagatagcctgacacttagctgtcatgatcaggggaaaactcagagggagcggcatttgggccaatgcaaaagtgatgggaaggaggcaggaagccagggggaatggcaagagtcaaggccctgaaaagctactgacagggcttcttcagaggtgaaggagaggaccagtgtgggctggatcctggtgggtgagggagagagttgcaggaaaggaagctactgaagtaggttgggggccaggtcagggattaaaaaggtcttaaagcccttgctaacataactgaatgtaattctaattgcagcgagaagccattcaagaattttatctaaaggaactaatttactagaaaaaaataaagatttaggtgtgtcactatrtaagaacaaatgttacattaaaactcattaggataaatgccttgtagcttgaaggtttagatggaaagtgagattgtcgttttcagtcaaacagaattcaagtgtttcaatttaaccactcatgaatattgctccaaataaattaaatgacctacatcaaagagtgtcattagcagttttaaktattcaatttttaaaattaaagatggttggctttactttatagcagtagttggttctttgctcttgtcgatagtttgtggtgtgctcttaccagatgctactcttattatccgaatgaaaatagattcaggtgatattgtagatcatagttgtcactgaatctgaatatattcattctcgaaaccctcatcaacaagactagcatctgttgggaagaaaatcgcccctatttttggttgtatgctcattattttctcatttaagttctgtcactcctgcattattacagcatgaagccactttcttttttcatcaaaatgttaccacggtgtagtttcatttctacgtagttcatagttcatttctatgtactatggactgtgtaggtaatttctacatagttcatttctacatagcttgctgctttttgctagcagctgtatatgctaagaagaacatggtcatttgagtgaatgttgagtgaaaatggctttggacattatttcttttcttctctggctctatccaagatggcaggacattttgggtattatagccacagtggaagaatatgtagggcattgaggtttcctatattaacamagtatcactttgaacccagctacaacttcaaattctgtctgtgcttttagcatgcctgatatctacttgctcttctgcatctgctacaggtaaaactgagataaattttataatttaacatcttgtgacttgttaaaatggatgtagatccagcaatccctcttctgggtatatacctgcttttgttttaattctggagatttctatcaaaattttcaagcagctcagaaattgtcttattttccatagcaactagtagtataaattgtgttcttttatttccaggaaatgcttccagactgcacacttttacttagaggacagtacatcccctagagttatatccacacctccaacacctatctttccaatttcaggtaatggcttaaagtgtgaccatgagtagctggtagatgttgaacaaaaagcacaatgttgaaaggtttgtttttatcgggacactatgcaaattgctataatgtagattagtaaatttttgtgttgccccaaatatttattacattatgttccaggtactcaggtttatattctgtcctcattaattttaaacgttcttaatcatacagatgatattgcaaaaatagtttataattgttcaggtgtattatgttaaaaacataaacatttatagcaataaaatattagttaagaataatggtgacttttacttattcctattatgttaatggaaacccaagcaacaaaagtcagattaagtcaatgcagaaaatgtggatgggaaaaaaatgacaaaaataaggataaagtcttgttcctttctgattacttgagtttatgtgagaaaaggkttttttttttttaacctacattagaagaaaagatctataaaattgtggtggtaatagcaggaaaagccatgaacacaaacaatatatggttgcttgaaataatctctcaaaatgttgaacagttgaatatttgggaagactttagctatttttatcataatttatctgaataacagtattcaaaggtagccagggtcattttgatagagacatccattaatcctagagtttacactataagtaaaatcataaccactcatttttaatataaattcaaggggtgcatgtgcaggtttgctacatggacatgttgcatattcaagccacttatttaattaacattttataacatcttggattgaaaagtggcaacaaaaaatagtggtctagaattgtgtgatctgggaaatagaggacaataaaaggaaagagaagttaagaaagtagggatacaaaaggagaaagtcatctatgggatcatttcacagatggcactttttaaattctctgactgatgctccatattccattgctagaggctcaagttctacaggatgttatcttctgaaatctcatgacttaaaaaacagaaaaaaagtcaaacattttatttatattttacatttatatgttgatgtttgttatatgtttatgtcatatgttatatatattatttatatatatttaactatgatattttctttttgtgccttataaacttaggaattgtgtttgctatttttcctcttttgtcaagtctgtgtctttaagcaccactgttttatttgtttttctagtttacattaaaatactattattttagtaccacagtgtctcattgccatattcagaatttttagaccaacagctctcagttatctgttacattttgattcccttcacttccaaacatgtctcttctgcataccccatcagcatgggtatgcagattaactaaaattttatccaaagtccaacatggtttatttttaacaaataaaataatacaaaatcagacctagtccaggagatccaaactcccctgttttgagtgtcaaaagagtggtgattcaagggcatctccttatttcacttgttcagttctcaaagattccctcttgatcacctgaatatgcatgttttcgtgtaaaaatcagaaagcaaaatgaatgttagtctcacttacttgcagaccaattaataaaagaaattaccaaaatacctgactgtcaataaaaggtactagtctacttatgaaaggaggttggctgtgcaggataacatcaaggggtttgaaggacatttactaggactaatgacttacatgtgacaaatcatttctgttttcttatctaattataaaagcttctamgcaagatccttctataagtgtgaaggtagaattacacctttgtctagtgtttcttaagcttgactgactaattcaattttagtattcagatccactcatctaagagagagaacagatggattccagtttttttttatcagcaaattcttggtaactgaagctttaaaatattagatggcctaaatgctgaacatctgttgctataaataactgtttctagtgaaatgtgtttgatgtttccttgtcagagaaatcacttgtaaaattgcatactgtgaactagtaatatattcagtctaagaaagtctttccaggaaaagaaaaaaaaatcagaaccagttaaaataatttggccccttcacaattaattaacagatccaatgactttgtttacatagcatattttcaagttagaattcttgaaattttacagattaaaagtcccaaaggcttttgacattatccttaatgaaattctccatataaatgttttctattatttacagagagaaggaaaaaatgttttcaaatgtaaacatctatttgactgtaagacattamattgtacagttttacaaaaccgaaattacactatttattatgcktggtccacactaaaattgaaactatattatttctacattttttctcagaatttacatgcaacatccaggcatgttaaagaaagttgtccatcaaaagatgcagtccactgataaggagtggggctatggtggtatttataaattaacattgaaaataagtgattttatctttaggtatagatggaaaagagattgctgaacaaatcagatttctgaaatacaggttttgattgataataaatgtagagaaaattggtaattgttgcttaacaattgaatgctgagatttagttagaaktatacaaataattgaagttgtttcagaagctactttataagtgataggtacgtttatttctgttaaattatgctctctaacacaatttttttattcacrtagatgatgtcggagcaattccaataaagcactttccaaagcatgttgcagatttacatgcaagtagtgggtttactgaagaatttgaggtatgattttaatatgtctattttaaataatatagaaaatagtaaaatttaaaagattcagcaataggctatttcttgacctaaagacagtgcaaccatttgcacttctagtaaaaatatgagttccataattacatatgtgtttaggagatgtgttatagttactatataatttagacaattggttttctattttaaaagccaagttgtactggtggaaacataaaaaacattgttcattttcttccataaagtacaaatctttaatattcttttttaaaatctgaattaataacaatgattctttttaattttctaaattmtataaattatactaaactactaaatttcatgatttccagccaaattacataaaaattcttaactgtgatttgtacaccagtgttaatgcaaaagcatttagataacacttacattataccaggtaaaaatgtatcttcttttcaagaaaatatgcatttctaaaaaaaatttgaacttcaaaatcagtaagttttttccaatgatattctgttaaaatactcttagacagaagggcagagaaatttactgcaaatttatcatggcccactgaactatcagctaagtagatttttcaaaatagagagctgtaagcacaaaggtaacaataaaaaccacaaaaaataaaagctaccctttgtgaacaccttcttacatgtcagtggactacatgctttcacattcaactttcacccatctctgggaattacttgttattatttctattcatattattgatgaaatcaaacttcatagaatttaattaacaactgataaataacagagttccattcaaacctaagtctgtgatttaaaaactcatgtcctttccactgtagctgtaagcaggaaggctgtcttcagcctccccgctggccattccccactagagagcttcatattgcatttttgcttctctctcccctaaccccagtggctctgcggacctccctctttgaagtactttgagctgtaagcctaatcacaaaatccactctctcctgattttctttccccactgcacccagcagttgcttcccaggactcacacccatcattatttatttagggaggcaaaatgttatagattagaaagctttaagaaatcaaaagaaagagaggtatgatatgtttttactaatttaaaaataatagaagccaatttatttaattctaaaagaaatctaaatcatagctacattgaataagaaagcagtgtgaggcagtactaagtagggtggaataatataaataattacatgtctaaaacatcaaattattttttattattttgacaggctagaggttacgcatgctatagtgttaactcaatgttaattttagtgttaactgatagaaattatcaggctaacatctaacaaaataagaaaaaatagacaatttataatataaattactgacaacatatacaaattcatggttttcataactataaaatcattttgaatattattaagcagtccaaaataattaaattaataaaataactycatgttttcacttttaaagttttttcttaattctatctcttttaactcactgcctgattcaagaaaattttacattaactgaataattagcttagtaactaatagcgttataccttttaagtggttcttacatcaaattgcttttaattgttcagaatgacttgctgcaaaagaagccttaaaaggttatgtggagggagattgggccatttgctgatgaatcagatttttattttggttatctactttctcagaaattataaggcttttattttattatataatactaaataattataaattctaaacagatagaaaatatttctgaaagcatattaactcatttttaataaaaaaatgggcagaaataaattttctttacttactgaagtttaaacaaaaagaggtctgctaattaaatatttagagtgttatgctatctaaattttgtttcaaaatgatgtaatgtgtatgatttttaaaatttttaggaaatgattaatgttttgatagccttaaatctgttacaaaccacctaataggaagctgtttactttttaaagtaaccccccaaaaaataaaaacaaaaaagcacatcactaattcagagtttcaaatagtgctactatggtcaaataaaataaaatttggatattagccaatctgactaatatgacaaaatgtatcatggaatatgtggttcctctcatctgcatttttaaaatcatcatattatgacatcactatctccttttaaaagtgttatgttttcttttacataattttaaagttccaaattattagacattytgatttgcatgcaactgtttgaaacattctgttgtgttagtatttgacaaatgtatttattgcatgatcatagttttccattgtaaacctaatatgaacgcttttttttctcatttgtcgtgtgctgwggaatttgatttctttacttttttggcattcattccctcattagacactgaaagagttttaccaggtaaggcattatttcactgcattttcttttagccaagaagtagttgtaacttttaaaaaatttcatttgatagattattttgtttgttttgtcttcgttattatattttaaggcacgttgtttgaaagaatgtgtgttaaaatgatttacatataattttttacaggaagtgcagagctgtactgttgacttaggtattacagcagacagctccaaccacccagacaacaagcacaagaatcgatacataaatatcgttgcctgtaagtatattcttaaatcagctctgacttcaatatcattgccattttggtgccttttaaaagtgtcctgaagtcatctgagagctgaccttagtgtggctgtttggggcctttttatcagggaataataagacttgtgttagataatatgtagcattatatcactctgacttaaataccttctgcaattaataacatctgttttatttaaacaaaacaaacttagaattttaatccaattctttcttttgttctttctttcatagactgttcatctcccttggtggtttttgtcattatttatatgacttggtcctattttcacctaggatttgcttactcttatgtgaatttaccaaccgaattacattttctttaaactttctcttttttcttctacctttacctgtttcctccctttcttggcattcttcctggggtcttataaagaattagttggattctttcttttaattctttctttctctttgttttcttagcctttctctctccctttctcctcaatgagcagctatctggcttttttcattagtgcaattttacgtaatatttctctatgaaattattgtctttcttctgtcttcttatagcacttctggttgcatttgttccctcttatttttgtttatattccccttcatctcctaaaattcatcttcgtgctccctccccactccaaaaacaaacaaacaaacaaataaacattctacttataccctttctatatattcagtggygtggcccttcctggcttcataggaccatggtattaccaacgaggttatttaaattctggtttcattctagttctgaaagccaatggagctgcactcttctccctgttactatcatgatctcttatatagtttgtatagatgttgccattctttccacagagtttacactaatttttattttttagtagagggctttatgtttgtcttcctgaactgcgtctatcctggctacacataaaactcacttgcttcttgagataaaattattagactttcctctacaagctaaatagaacatacgcatcaggtaattaagaaggagacagagattaacatttgatgaacacctacctactatgtggctggcactgtaaataagttatttcatttaatccctgaaacaaccaggcaagataggaaattgtccaattttagagataaagaaaaacaatccagaaattctaaaactattaaaaccaaactacaaaaataggtcaccctgacattgagacccatctgtcagttgccatacttccatttgcacatacattcctgtatcagtgtgacctgttaccatcacagaagtattcatatcccagagtatctctttaacttgttttggtttggtctgtattcacttcttcatccttgaaaagaataatcttctcagtgaaactgccatgtttccttcaagtaatactttatttctcatatgtattttctccaaataaatagtttttctgtagaactgaatttaatctcaaactcctgtaatcatactttgaattaccatagttataccttatatcatttaccagattttgcatccatcctgttttcactggcagtgtgctatctacctcctctgtgcttgagcagctgttctcctgcctccttttgaagcagtttctctttgaggctcctcctgaaagagctgtttgctgtaaccattcacagaaacttcctagggaacctttggctttcttctctatctcttcttccttcatcagcctcctgttcatccttacctagctttgtgagcctccccacccatcacatttttatctcttcgagaagctctccactgttcacagcccttgtaaccaaccttaaaattccatttaaaagaccaacttcagatgtcaacctctatagaaacttttatctcaaacyaaaacaatttctgttttcatatccctccactacattgcacctctcacttgacacctgtgtatataccctagtttcacctattaccttagaaatgttcctgagggtggagattctttttatatttgtctttgttttctttgctgtctctgtatccccaaaaagcctatgaaagtaaatgattgcttgtgttgattttaattgaatgaaataaattattatgcaaatatgaattatctttgtgctgaaaagtagtctgtgctacaatgaaatatattctctttatattacagatgatcatagcagggttaagctagcacagcttgctgaaaaggatggcaaactgactgattatatcaatgccaattatgttgatgtaagcatgttttaattgaaaattttatagaaatcatattagactgaattattataccataatgccatacatgcatacatatactagtgcttaatgtcatgttattcgatagagaataaaaatggtaaagtaacagtaaataatttttaagagagcctatgactaaaaattttcatattaaatgacaytcaagctattttacttggtttatctcctgagtgaggaaaggaattcatgatgggagtgtaccttcagggtggaatrggtagattcagataggtttctaactctttagatgtgaagggcagggctgggcgcggtggctcacgcctgtaatcccagaactttgggaggctgaggcaggcggatcacgaggtcagaagatcgagaccatcctagctaacacggtgaaaccccatctctactaaaaatacaaaaaaaaattagctgggcgttgtggcgggcgcctgtagtcccagctactcgggaggctgaggcaggagaatggcgtgaacccgggaggcagagtttgcagtgagccgagatcgcacttctgcactccagcctgggcaacagagygagactccgtctcagaaaaaaaaaaaatgtgaagggcagggccaaggcttattttaagtttcccatagctcctggcacaaggatgtgcatttagctgatgaacaaaaaatttccatagtagtactgattaaaaggcaaacatgattattaatccagttatcaacctttataattttgggtattcctcaggatacccagctttgtggaacttactgggactctccagagactgtagaccgctcactaactaaattggtttttcactgtgatcacctgaatgtcagcagaactcaattacttccctaagatgcacctctcagtctagctggcttcaggttaatactgtgtggaatactgaattcaaataaatgagtacataagtataaagtgggtttgttacaggcaactgtttcatgcttcctgaggaggaaatatgcatgtcagaatgaacatgagatctggagttagaactgattttgaatcccatctctgccactggctagctgtgggactttggaaagccacttaactcctctgagctttaggttcctcatctccacatcagggttgatgcttccattttgcatagatgaaagattaaggttcacgttctgtattagtctatgaaggacactgctatgaaggaatacccaagactgggtaatttataaagaaaagaggtttaattttctcatagttctgcatggctagggaggtctcgggaaacttacagtcatggtgaaaggcacctcttcacagaatggcaggagagagaatgagtgcccagtaaggaggaaagccctttttataaccatcagatctcatgagaactcactcactctcacgagaacagcgtgggggaaatcaccctcatgattccattatttccacctggttcctcccacaacacacaggaattatggaaactacaatttaagatgagatttgggtgggaaaacagccaatccatattatgcccataaaacatcttgtacaaaatgggacacagtgacgaattgctaataatgattagcacttctcakcacrttgaagtagagtaaggaggttacactccagatgcttttttaagctgttgtagacatctgagcccagtgcctaaaatacatttcaaagcagtgctattaaagacttgattttaagcatagcaagtagaccgcaaatggattaaatacacttggaatacaaatgcacagaattatagttgtgtcaaagcaaagagagctattctttttttttttttttttttttttacaaaaatgatagggatccttctgcttcctaaccaagagtattttctaaccaagagtagctatcttagttggtaccatcaaatttctccaactttgcaagtttattttttatggttttcttttacgaaaaattatgctgaccttaaaaacttaggcattgtacagttaaagatgacatataaatcagttagtaggaaacatttgtcatttaattcttcagggctacaacagaccaaaagcttatattgctgcccaaggcccactgaaatccacagctgaagatttctggagaatgatatgggaacataatgtggaagttattgtcatgataacaaacctcgtggagaaaggaagggtatgtagataatctgttatgtcacccccaaaaaagtaattagaggtactttaaattagttttaatagagtcagcattaggaaggagccaaagttttgagagttatttgggattcttttttagtaaatatgacagctaaagggaaactgttaatactgttagtcaaaaagtttcattatgaatcatgctrtctgccttttaaacgcattcttcatactgtgggagaagtaaatgggactcattgaaaagcaatgtagagtgaaatcgattttaattcacaggacatggattttagtcttggctctgtaacctgaatcttctgactcacttgccttatctgaaaggggaaattttagggtacctcatctcagtctcgttcagctctcagattctatccctagcctcctccacaactaatttcagtcacttataaagaaaataaaacatttagaagagtgaaggagtccattcctgtcaccatctcagacctttactgatttcagggaatgacttttacatggagcatttgaaatacagaagtaacatctacattttcttttgcagagaaaatgtgatcagtactggcctgccgatgggagtgaggagtacgggaactttctggtcactcagaagagtgtgcaagtgcttgcctattatactgtgaggaattttactctaagaaacacaaaaataaaaaaggtgagtcaacaaaatgatgggcataatcaagtgaacaatgcatttggtcattttttaagtgaataagcgatagaaccaagaaagggtaaaaagcatataactaaaggcattaaaaattcttgtaaccaggccaggtgcatggcttatgcctgtaatcccaggacattgggaggccaaggtgggtgaattacttgaggtcaggaggtcgagactagcctggccaacatggtgaaaccccatatctactaaaaatgcaaaaatttgctgagtgtggtggtgcacacttgggaggctgaagcacaggaatcacatgtacccaggaggcagaggttgcagtgagctaagatcatgccactgcactccagcctgggcaacagagtgagactctgtcaaaaaaaaaagaaaagaaaaaaaaaaagaattcttatcacagctgccgtcagtcctaaaggtttctttcaggtctctagatgcctgttgtggctttggagccagactggttttgttgctgatgtttaaagtgaatgtgatacatgaacagaaattcctaccttgtgtggcaactgcataggatggccctgacacaatcccaatattcaactaaaaagagtggagagtgaaacaagaaaaagaaaggaaacacgaagaataacgtattactcaggttcttcaaagaaacagaaccaacagaatagagagatagagaggtttacatttttaagaattgactcacatgatcatggggattagcaaatcttaaacctgtaggacaggctggcagcctagaaattctggtaggatctttacgttgcactgttgagaagaattctttattcttcaggtaacctatcctatcagtctttgttcttacagccttcaagtggttgaatggagctcacccacattatggactatgatttgctttactcaaagtctgctgacttacatgttaatcacatctaaacaaaatacctttacagcaacattttgtgtgattagtgttgaccaaacaatgggccaccatagtatagccaagtggacacaaaattaaccatcacaaatgacactctactttctttcattcattatggaccctcaacatcaaatcaagctatgattcctgacttgctgttgaagaaccgtgtgtgtgtgtgtgtgtgtgtgtgtgtgtgtgtgtgtgtgtgtgtgtttgactgttattaactgtctgaacttttccagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcaggtgagtctcagagatgtgcctctaaacccatagaattgcttatacttgcaaaaaggaaatcaatggaacaaagcttttgcccaaatgggaatgatttcttgaaatgagggtgatgaaattatatgttcattttcataagtattgatcactaggaaatgaacatgccagactcagaattggattgctgaatatttctaagcaccacatattttttgatgttgattattttatttgattgttcaactgcatttcagcttattaactatttgaggcaggtggaacaatgtttttgttgttaaacaaatatttacctcaacatataataccatgggataaaaatgcttgagctacaacccctgtccctaggagttaaaattmtgttttagaattattatgccaggcttgtatcacagaagccaaagcacacagattgtgagaaatttggcaaaatatatttaagttgtttttaaacattttgggaccagaatccctttttcattttcttgagttttaatacattacattgaatgtattgtcaattcattgttgccaagattttttaatttccaagactaggttgataaatagaaataatgatgtttcaatgaaagaggaaaaatgttgaaaatccttatttaatgttttcagttaaaataataatagcagttaatatttattgagtgctgactgtgtgccaagccttagatcacaaaaatcaaatttgtttctatgtgaagtattgttatcaaagcagtgtgtttttagagaatcaagtgtttgcctttgatatatagcttatctaacacattctaattaccatctcaggagttaaatttgagagacccatcttgaggctttttaatctgttagcctgattataaactgaggaaaacaggaagatgcaagaaaaatagtgctgaaggtcagggattgtttcctagcaaacggagaaggaccaggctattgtgcagagcaggtgctaattttccactctagcacttcctacttgtcggaacatttgaaaagaatccctgtccgtgaattctgtccctctgctagaggctttgaagaagtcgatagataatggccctttagaaataactgaagtcatgctttattcctcacaatctcactgaaatgatattttcagcagaaagctttatcaaattctttttcccattaacgcagaaatctttacaaacatgtctacctggaaacatagacctagggactttttcttttcagaatttggtgaagttaaagctttcacttttgtcagattaaatgtctatttgccacactctgatacataatattttcattgtacaatatacaatgaataataaatatggtttttgaaagttttaaaatctccaacagatatagtgaggttgttttgcaattagacacatgacaaaacattagaaagggtacttctaaatttgttgtgtaaagcattacgcttaattactaaactgtttacaatattgaattgccaaatgtattgtgtggctcactcgcttgaagaaggaagttattttaatcaacatgacaaccagtagtgatctatttttcaaatttattttatgcttaacattgaaatatttatttcttggtcttctcttcagtgctggagttggaagaacaggcacatatattgtgctagacagtatgttgcagcagattcaacacgaaggaactgtcaacatatttggcttcttaaaacacatccgttcacaaagaaattatttggtacaaactgaggtatgatttttaaaaagatgattttattcatctaaggtatggaaatgtcactaaaatgtaggtgtattcatctcctaggactgcaaaacaaagtaatacaaactgggtgggttagaacaacagaagtttattgtctcatagttctgatgtctgtaggcccatgcccttccagaagcctctagaagattcttccttgcctctttcatctcctggtagccccatgcattgcgtggcttgtggcagcacaattccagtctcagtcttcacttggctgtttccctctgtgtctgtgtctgtatccaaattttcctcctcttataagcataccagttatcctcctcctccagttgatctcatcttaactgattacatctgtaacaaacttttatgcaaataaaatcacactctgagttatcaggcggttagagctttaatatatctttgtggggggacaccattcaacccatgacaccagtaactgcagctatgtcatgaatgagccagataaattttatctgttttgtgaccccaaatagggaatatcctttraaatgacactggtcacagagaagatacagcaaaagtctaagtagagtggtccacacacatccttgctagcaaaaatctcaagttcttcatatacatagtggatgaatcaattcattttttaaaaaaatatgaattatgcttaaattatatccattttaagcccatatagtttacccgtaagtgacagaacagtgtcagcaaatctgcattttatcttcactgtttctaaataaaaatgaacttaaatggaaacctatgaatggcagcttgaaagcaatcagaaacacatggctgagtgggcttcaaaacgaaaccacaccaaacatccttccatccattatcctaagcaaacttacacaggaacagaaaaccaaataccacatgttctcacttataagtgggagctaaatgatgagaacacatggagacatagaggggaacaayacacactggggcctttcagagggtggaggatggcaggagggagagaatcaggaaaaataactaatggactaatgggtatgagccttaatacctgggtgatgaaatagtctatacaacaaacccccatgacacaagttgacctgtgtaacaaacctgcacatgtacccctgaacttaaaataaacattaaaaaataacattctggtcatataagaccaagaaagagtcccgtatgtgaaatatcagagaactattaactatatataaaattgagttaaattgtatatgacaagcgaaaaggagagttggcgttgccagaaggggtaggcccaccagaagtgtagaagtcaagaaagccctctcatgaagtatagaggtgtcaagtttgaaggataggcagagaggacattcctttgccttgccaactcttcctgcctcctaacctattgtgtattgccaacaatacataataaatgaagaggtaakgaatgagaagaggttctttcttctgtgaccacttcctttcctctgtctgacttccttccaggttttgtaagcaatcttgtgtgggtcttcccccattctgtaaaactctccttgtctgtcaatggaaggtactatgtttgtaggtagatacatatgaggaaaacttgaactaatgttgcttattgtcattgttttgccaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccaggtgagtcctcttggaagcctcttggatgtcactacagaactgaatgtccctgcrtcttctcatttgagttgacagggtcacgttgagtgggcagtrtgggtacaatgactttgtatttgagccatcgttgttccttactgtgggctacagtgccacatggtaaatttcaaggagaaacataattctgagcagcaagaggaaaagttctcagaaaccttaaactaacttttataaatgcaaacttggtcgagaaaaraagggcacagagcataacagaatgaacagaaagaacttgtaaaacatactatataagtgctctttttactttgaaaaaaaaaaacagaccacttaaacatgagtgcggtggctcaggctgttcctgatactctttggaaaaaatctgtgtctcacttgaaacccctggaccaaagtagtacacactggaataatagcttcttcaaccccagtttctccccctcaccctgtctcaaggccataagccagagacaagagcatgttttgtccatattgtacttcccacaataccagctctctgactttcagaaatcagtaggcaaagaattcagaaagcaggtgttaccggacctgccagctgagaccaaagcatgtgcagaatcgtagctttccacaggaatgggggctatattatttcactccacattgttcctgtgctatctgcttgcttctcagagttcctggagaaatagggccaaattttgaagaatgaatatctgggaagaatttggaagaccttagaaaaacccaggagagttaacaaatgttgagatttcacttatttctcctgctttgctccccagtctacagcataggatgttagccaccatgaattcctttgggccatttgccttttaaattactgcacggtgtgcctttggaggtgtaagagaaagattgggatcaatactgagtttagaacctgttgtcagaaagtcatacatgttttactcatccaagcttatctcagtcataaaggaatgccttaggggggaaaagagtatgcagttggttttcagataataaagaaatgttaaaatgtaattaagttgtaaagatatcttttccctaaataaattacacacacacacacacacacacacacacacacacacacacaatattacccatttcaaaaaaactctcatttaaatatgatttgcccctgtgtagttgcataaaaacattgatatggtaagctaaataatccaggatcaaaatgaaaatattaactataaggtcagaattcaattgaaaagagagatattttactctctttcctgttaacatcataaatagggaaatgtatttgtgtgtatgtgtgtgtaccatcccataaaaagatatctattcgagtttgtctgtagaaaatttccttgaaataagttgaatatctgtgtattcagcaagtacttatcagacacctgccagatgccaggcttttgtgttattagggcgcaaacaagaatttgtaaaataaataaataaagcacacccagctcctagtcttatggtgcctgcagtctattagaagatacaggtaagaaaacacaaacaggccaggtgcagtgggtcacacctgtaattcctctgttttgggggaccatggtcaagaatttgagaccagcttgggcaacagagcaagaccctgtctctataaaaaaattagctgggtgggtggcatgagcctgtagtcctagctacttcagaggctgaggtgagagaattgcctgagctcagaagttcaagattacagtgagctatgattgtgccactgcactccagtctgggagatagagtgagaccttgtctctaaaaaaataaaaaagaaagaaagaaacagataaacaaaatagtgtgaaaaatgccattatagaggtaaaacaggatgctgtaggagtacaggtaaggatgcaacttaccagaggagaattgcgtaagatatatttaagagttgaacacaggatttggtgattcattggacattgcagagagagaggagagaaaagacacaagcataactactcagattctgtttgggcactgggaaagtagtgatgtcattcaccatgatcgagaattcaggaagaggaggtggtacatgcttgagaggtgtggtgagggagaagacgtgagatatttccaaatctaccttatttttaggttaytgggagatgtcccaataaacatgtatatttggcagttggatactggttctgaagcataagagaggtctggcctgaagaaatggatttgggagtgatcagcgtagagatggttccttgaagcctcggaattggataaaatagccaattaaaaatgaaatgtctaagaaaggttagaaaggattacttaagaaaacattttaattaacctatgaatggccagcccacaaaggaaaggggggaaagtggcatcagaaggtaggagaaaattcgggacagcggaatatactaggatccaaagtaaataatgtttcttgaaagaggaagtgaacagagatggcaagtgctaatgacaaatcaagtatgttgggaatggaggaggccgttggatttagacagaagtcattgatgacctttgtctaagagctatttgaaaagtatagcattgacaccagattacagggagttaaggagtaaatggatttgaggaattaaagacaattatataactcttaaaaattgtttactctggatagaatgattaagataactataagaaaactttgagttagtaagatttgggggktgtttatttggggtttctttgcttatgttttaatatgagacatgagagcttctttaaaaactaatgggaagggagataattggagwgtacagagaccctgggtggtacaaagaggcgggattcaggacacaggtaaaggaattagtgttcaaaatcagtaaaacctatgtgcatgtttacagtagtacacatataggctctaaggctggaggctgaggaagtactctacggtttctattatctgtgaagagaaggtgggtgtgtgtgagtgtgtgtgtgtggtgtgttgctacatatattcctttttttttttttttcctctgagacagggtctcactctgtcacccaggctggagtgcagaggcacaatctcggctcactgcaaccttcctctccctggcttaactgatcctcctacctcagcctcccgagtggctaggactatagtaagtgtacacaaccacgcctggttaattttttaaatgttttttgtagagatggggtttcgccatgttgcccagatggtttcgaactcctgagctcaatcgatctgcctgctgtggcctcacaaagtgctggaattatagccatgagccactgcrcctggcccattgcacacatactctaaaataaaactgttaatagatgcagagggaaaagggagataattttaaggaatctrtatcatatcagtcattttctcagagtataayacagtaaaaattggaaattgacagtgaaaggtttccataaaaattttgatatttgggcattaaaaatacccttttaaataatatacatatttaagaggaaattataaaatctttagaattaaaggtcaaaagaagcactacataacatttttaaagtttttaaaattaaatagaaaattaaaatgattaaataaagatttaacaaaacctaatgcaggttctatcaaaagactattaaaatagacaaacctgkgtccagattgatgaagggaggaaagaatgtgagtaaataatattgagattaaaaaaagagatataatttagaaacatttttaaacacaaaagcatactttgaatatatttgtgacaatacatttgaaaacctatatgaaatgaataatttattgtatgttctaaaataactaaaagcatatcattggattgtttgtaacacaaagaaaggttaaatgcttgaggtgatggatgccccatttaccctcctgtgattattatgcattgtatgcctgcatcagatagctcatgttttccataaatattacaccttttatgtacccaaagaaatgaaaactaaaaagaatttttaaaggaaaaatataatgaaaatacactaaaaatatatagaaaatttaactaggccaatagccattaaggaaatcaaatcagctgcctaaaatcccaccttcaaaatataaccaggcccaaaataatttaatgtcacattttaccaatttttaaggcacagaaaattccaaatgttagcataaaaaatccaggtggaaaactaacccagctattttattggacaaatataactttgataccaaaactgaacaaagacagaataagacacttataggccagtatcaataatcttatttaaaatatcagcaactcaaatccagcagtgtatttctttaatatcatgagcaagtagagtttatagggtttattccaaaaatgaaatgatggtttaacactggaaaatatgaatagatttacataaagaaacattatgaccctgtcaattaatacaggaaaagtagtcaatcaaattctatattgttcatttaaaaaaagaactcttagtaaaccagaaatagaagaaagctttcttagccttctagaaagtatctgtcataaaactacaataaacatcatacataaaaattaaaattggaaatgctcatagtagattccagaaaagataaggaatgtcaattattggccctgctattcaacattattctggaaatagaattaaactagatagatgtataaaggtagaaaaggatttgcagatagataatataactacctgcaaagaatatcaagagaagcaaaagagaaaataattttctttagttagagtttaataaacatacataaaaatcaatagcattgttatttgttagctttgagtgattagaaaatgttttagaacaaaaaagaacccaatcattaacaaaaacaataacaaaacagtagcaaaaacttcatcatctcaaaaaagacacttaacaaaatgtgcagtaaatatagagaaatttataaaagtgaattgaagagcataaaattaggcccaaataaaatataatgttgatacatggaaatattaagatattgcttctccttacattgactatagaagtcaatgcagtatcaatcgaatttatggcaggatttttcatggaaaatgtagaacagattttaatttagcatggaaaattaaacagccaaaatatctcacctatactgaaaaggaaataataatagaagaattctgttgtactgtatatggaagacttatgatgtgatataatagtattggaaaacggaggaatctagcagaggaatgatgcatttgaggaaatctgttatgtggtagagwtaacattacgtatcagtgaagaaacagcagattaatctataaataacattgggaaaattttcatgtcaaaaaaagtaacattgtatctctaccactcctcaaacactaaaatgtattcaagatggattaactacctaaaggtgaaagcaaacctttataactattgtaagatcattttagaaaagaaaatattgggttgggcacagtagctcacaccagtaatcccaatactttgggaggccaaggcagggggattgcttgagcccaggagttcgagaccagcctgggtaatatggtgaaaccccttctctataaaaaataccaaaattagccaggtgtggtggtgcatgcctgtagtgccagccactcgggaggctgaggcaggaggaactcatgagcacaggagattgaagctgcatgcactccagcctgggtgacagagtggacacctgtctcaaaaaagaattgaaggggaggagaggggagggaaaaggagaggaggggaggggaggaaaatgcacagcagggcatatattggaaagtatttcttaataacttcaggatagagaaggacttcttacgtaaaatgataatttgcagaaaacttaaataagaaaaataaattggctgtaaatctctgtgtgattaaagaaactgaagatgtttccaactttttacacactatagatttacattcaagacagcaagaaccccctacaaattaataagtggaaatgaagtaaaaatatgaaaaggcaatcatcaaagaagatatcttaatgactaatgagcaccaaaattcacaatttcacagaaattaagacgatgcaaatcaaaaccatgatatactatttttcatttayccgactgtcaaaaataaaacactgaataactgaatactcctaatgctctatggaaaccgtcacacatgtgcacattaagagacatacaggagatgctcatatctataaagctatacaattgcaaaacactgcaaatacccaaatattcactagctgaggagtagataaacagaatgtagattattcatgtaatggagtagtaacagaaggaataaataaaattgaattatatacatatatatgtatatacacacacacgatgtaatttacctccaaacgtctgtgtgagatttaaatagaggaaatggaggttgcacatctatagtggaagccgtgaggaagattatctcaatgctaaaagaattactagagatttctttgcttcttgtaactcccctggtgtaaaacayagaagctccaggaagttcactaaaacaaggttaaattcaaggaattgttggaaaacatttcatatatatttttagtcagtatcttatcttgattggtgtgtgtgtgtgtgtctgtatgtatgtgtgtgtgtgtgtatttgggggacttaaatgaaataacctatatatttttttactttcttgcccagctcctgagccagtcaaatatacagcagagtgactattctgcagccctaaagcaatgcaacagggaaaagaatcgaacttcttctatcatccctggtaagttgtgttgatccttgaaaaaacaacttttttaaaataataaaagccttgtaggaaatttggcaatatttgtatacctttggagcaaatggagcacattcaaatatttttaattttgtccaatatgtaactgttccaaaggactcataaatccttgaagtcttatctaaatatgcaaaatgtatagaaaaattagcttacagatcagagacacttcaacttgaaaaatgtagctatattttacatctggcatggggaaaagatggtacagtgctgtgagcatgagttgttttgttttgttttgttttgttttgttttacaatgaatgttctgtgttccagtggaaagatcaagggttggcatttcatccctgagtggagaaggcacagactacatcaatgcctcctatatcatggtaagtcagagaagtcactgaggagactgccagcttgtgttacagggatcaaaaccagaatgggctgccagaagcaaagactacaggcatgggcaaatgagtggtaaatttaagttaaatctgttgactgcaagcccacagtccacagcaacagttgtaataatggcatgcttttatgtgtgctgggactgaagaaacctcaagcaagaccaattagcagatgcaggaacacaaactcaccatttagggctgatgagtagatataaaacttatacctgcttatctaaaaggctttatttccttcactaaggcagaacccctgagcaaacccgggattcactggcttcagcaaagcctaacctcactgacatcactacttcaggtttgcagcatgatttttagcctgcaaactgggctcattttaggacctggatttctaaagatacaatgcttttcttctgcatttacatcttttgtgtgagggatgagtgttttagtagctgttgtgtgaccttcattaacatttaaggtcaatcaatcacggagcttggcttctgatgaaaacctaattcttattccaaaacctctgttctatttatccagcaaagaaaatattaaggaatatctatgcaggaaacacagggatgtgtggtagtggcatctaaatacattcacatttcaaatgagccactgggtgataggaatgggatctgaaagcagaaggggctagaagagccaggactttagtaacagtataaatatcacagttaatacaatagctctagcttctaggtatctgtagcaaaatatgcaagatgtctccctggttcctctcttgtagaggcaaccaaggtgtctggacaccaaagtgggaaatgtaaactctcctgtagatttcccactctctgtggagtaagagacagtatccacaaagcagtttggtaagtctacagctagaggtgtgtttttaatgaaactgttcaagtttctctatcagcttagctgatagctaccattctcagtgaccaccagatgcccagatgaaagagcaccaataagggattcacctgcatgggttccattgagcagtctcacctaaagtcttcaatgaaaaaccacagtgtgaaaattcagagtttttagtatttatggaccctgaagggttcatggcactggaggccacatgcatagagcttaggcagagcaagcagggaaagagagaaaaggacccatggaccaatgcccccactgagtccagggcattatccaagtaggttttccatggggagttttacttgatgagtttaaagcaagcaggcacaagtcccaggaggttatgtagtgactgagaggtatttactatggcatatctgcaaagtccatgtaggtgtgagggtcagcgaggccagccaagcaggctgttctgtagtgaaatggtcactatggagcagttttgtaagttagacaactggatcgatcactttaaggaactggtggatgggacgatgtagaactggaaactgtatcaaggtgactgaaccctgcttctggcatgacaaagtccaacttatatttaaaaggaatgccaaggcaacataaaaatcataaacattcactacaagatgataggtaaccttgaatactacatctgacttcttaaggcaaacttgggcacaatgcttaatttctaaagcctcagtttaatcatctgtaaaatgggggtcacagttcctatctcacagtattgctgtgaggaacaaacgatttaagagaaaaaaaaacacatagtgtcacacctaacatacaaagtgcccagtaagcattggctataataatcatattactacatatagacacaatctgcaattcaaaagactattttgacttaaggtccattgatgtataaatgcttatctgaatgtttaaaggcatacgccagtgctgtttttgtcttctctttggttttgtagggctattaccagagcaatgaattcatcattacccagcaccctctccttcataccatcaaggatttctggaggatgatatgggaccataatgcccaactggtggttatgattcctgatggccaaaacatggtaagtcccttagaccacttttgggacttcctttacagaggaatatcaggttacaaacagcaaaaagtccagcatacaaacaagcaaagtaattttgttttcaactaataaactaatgtcattgaaggcatactcttctgctgttgggcttggtttcattatacaatctcctaggtcaaagtgatgaataaaagttttaaatgaaagtagatataaatgaacttaaatgtatgtgttttgtgacattgcttaagaaaattagaatcacagccatgaaagaaatcagtctatatgcttctatttacatttttaaaataaaatgtgttagaatatttagagattccctgagtttaaggaggtctctaattttttctttaaaaaaaagacctagttagaattaagtgatttcctagtataggaaggacttttttagtataagaaaagcagcgatatcccatccccctctttatatatgtttggagaacccaacaagtaaaataaatatttcatttaggctttacatgtttacttagctttgatattcagttcttatctataaagttattgtgtgaccattacacatgaggctggaaatttctgagctcttaaaatcacttgaatcttctgtactcagttgtcaattacagaagcaataagcttatcattgttgataagctaagagcataaaataataaagcaatagtttgggttcctaagtgtgatattttattcagcacatcaatctagttgaaggcacgagaaagatgttaagagtaaatattcagattcaaagaaaaattggagttgaaatttctgtgccaaccaattaactttatttcacaatctgacttattggtcattttattaaaatctagactcttctttcatttgcaattctgcaggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggtaaggatataagttaaatgacaaactttttatcttaaacacatgttaaacatattctgacctaaggatctgtcctagaaatgaaaagcatgattctgattttttccccattgagacaaatacacaaataatcaaattaccttgtcactttcattttcaaaatgatatagaatcattaaacaattagtcatcactacgtcattcctgaattttacacacacaggaaatcaaagctcatttactccagattagtggttgacagaacttaggtgaaaaataaacacagtaaaagaataaatttattaattttaattctcatgttttaatgtaatcccttaccttgtaagtaaaatgggaaaaatactacctacctaaactctcctaagtaaaatgggaaaaatrctacctaccgaaacttactattctctaccaatgtagaaagttgatgagtgatagtgatgtagtaagttgataaatgaagtgctttgaaaacacacaggacaataaactaagaatattttactaaagtcttggttatctattacacaagatactgttgttatctacaagataatacattgttttactaaacttaattatatgcaaatatctattattgaattatttgtcaatgattatttacatagaactatagtaaaatactaaaagatactaacaatgatgtctaaggaatgtgagattcagagtaccttctcaatatgacaaagattaaatcatgttccaaataatttgaatgtttcacttttctctagttctgaaaactagtacatatatggtatacaagaagattctctatcctctagaatatttaaatgaccaatacatataaacttgataatacaaataactaatagtgtaaacagcatagcagtggaatagtatcctatctcattaaaacaaaaaagacttaggtctttatttgtaaaatgaagggcagaaactagaaggctcgtaaggtccctgagagctcttaatgttccatgctaatttctatctctgattactccctgatcactttagtagcatccatttagatctgccatctctcatgccttctcattattcctagttagtaagaaascctattacaagagtaataatcattatatacctattatcttgtcacacccattatcctgatcactgatcatgtttaatatcttgctcagcactgggaaattagcactgtttttctcctagtattattcagaaaataaactagataatacaggttcctgattgatcctaattcagtatgtctcatctatgtaaatcagctattatggacaacttgataatccaggagcccaacccagggataaacagtatttctataacaaagatcaaaaaagaaggaaagactaaactggacagtttcattaacttcagacatttttaggcactttaaccaaatatcacatttgaggttagtagacaagtgaaggtctatgctactgagctcaaaagctaggggccttttatttatgtatttgttatgaggactatttttaagaatttattaaatattgaatatatttaagatgtttatattatatgtgcaaggtttgacaattatgttaaattacttttacccaccattgactttaagaaatagaacatggccttgaccatcaagtctttcatttgctccctatccccttcatcctctcctcacttcagaagtagcctcttcctgaattagtgtttattgttctcttgacttattttatcagttaacccttgtctttgttttccttcacacgcgtgctgcttacttttaaatatctgtgaactttatataaattatgtgtattatgctactcagatttatctatgtatttgggtatagttcaaattcatttactgctgctgcttagcattccagataatacatatccttttttctattttacatgcaaattattacttgtttgttgtgttttgtcttggtttgatgttgctattacgaacagtgctgatatgaatatttttagtcacatgcaaaatttcctcttggggatatcctgggaattcccctgctgtgttattgtgttggatcatcttcaactttctttaactttactaaatgaattcaattgttttccaaagtcatcctacaaaggtatcctctcatcaggaatgtatgagtgcactacatcctcatcagtgcttgtgctgggaatgaaacggcatctcttgttggttttaatttgcatttctcttgttgaaaatgaagttttcaacataactttacatttttacataattatttacataaataatatttttacatacaatatgttttatacatattatttttacataaacatatttttatataaattaattgaccattcagattttatcttttgtactgtgtctgttcatgatttttgcccatttttctgttaggttatttatcatttactgatttatcagaggtctcgtattgtggatactaatcctttgtcagctgcatatattgcaaatactttctcccagtttgggatttgaattttttactttctttgtgattctttttttttttttgtctttttttttgtgaaagaaaagttttgaagtttaatctatatgaatgtattgatctttttattcctggcctttaaaaggaaaccatcatttagtatcttaaaaaaataccttttaccctgaaatcatgaagatgctctcttacactgttttccaaacgtaccacctgaaattgactttttgtattatattttgtgagacaagggttcggtttcattattttccatgtgatacccattgtcccaccattatttatgaattagcaatatcagttcagtcattcatatagtgtgtgtgtgtgtgtgtgtatatatacatatatatatacatatatatatgtgtgcttgttctaggacatttattttattccattggtcactttgttcatccctcagccacaatggcagtgttttacttcttatagcttagagtaattcttgatatctgatgagttaatttcctctattgtttttcttatttaccagtatcttggctattttggccctttgcacttttatgtaaaatttaggttctgctacttgtttttaaaaaaggtatcatttttttaaaaaagtacacttttggaagctggaggcgagaagtttaagggatttatcaagtcacagtcttgttggtcacttaagtaagaatcagaattgggatccgagttgaacctagatctctacctccttgtcggcgttttctccactgtgtcatgcaatcttttacttaagcctgaggattactgataagtgaagaaagtgtatgctattttcaaaacagattttaacaccaatgatttccttttataaatttgaatttagccgtgcaaatacatctttgatacatagtttcatggtttgtaagcattggcatatttcacccacagatagagtttatttttagaataaaaaaagaaattatgttttttgattctactagtaaatctatgcatgttaaatgtggcatcacaactgtttcttccttctatgatgaagaatgtgctgcaactactgctgctcactcatgcctgccattgggttttattaccttactgtaattcctgattttcctcaatgattccactcctggtaaactgtcactaactamcattactttgtgttttcttgttataggatgattatgtacttgaagtgaggcactttcagtgtcctaaatggccaaatccagatagccccattagtaaaacttttgaacttataagtgttataaaagaagaagctgccaatagggatgggcctatgattgttcatgatgagtaagttccatgtgttagatggtttcacacctgcacattttctgggcatatgtatatttctgttgtcttcagacaaacctaatgctttggacccactgtgatgattcagccatggtggattatctgcatcttatcaataaagttaacacagaacatttttttttttttacttcacttgaagtccctgttgaagacagagaatggggtcatgatcacaaatatcttctcttgcatttgatgctgagaacactttgtatactaagtcggtgttttagcagtgaaattttcaggagccaaccagagaggcattttcagtcattgatttcctggcatagaagtgaaattgatatgatttttatttttcaggaacaagaaaccatccaataaatcttcctaggattccatcatagacaaataaaaaatgcatatgctgaacttatgttataaatatataaaatacagtttgttatatatgtatttatacattatattatatgtgtattatacatgtctttatatgatactctcaggtttttttttattattgccaactcctttcatagtatacaaataataaaccataagcaaatactaaacttctgtaaagtattccactattgatatcatgaacacttggcaatatttcagattaaatcatagttctttgtgcaaaaagcgaagagagacaattcattaaaagtttcagtgttttcactgcaaagttgtcaaggctatatgctttgtgagttctaaatgtgagtggtgcatctcaatggagtctttgttccttttcttttttttttttacaaggcatggaggagtgacggcaggaactttctgtgctctgacaacccttatgcaccaactagaaaaagaaaattccgtggatgtttaccaggkagccaagatgatcaatctgatgaggccaggagtctttgctgacattgtaagtaacaaggcagtgaacgaaatttttcactgatagagtacaactaacttcctagaggctgctgaaatcttatgtatcaagaaagatcttattaactgataacattagtatgtagttttcaagctgaattacaagtccacaawccatagaacaacaacatttaaaatttatacttcagaaaatttatggataaaaacttttaaatctcatgtttgcctttgtgcacaatagtaaacaatgcaaataagcttaggtgaatgtagaagtcataggctcaccttcagctctttggtctgtttaagggccttataaagggaccttcttcaaagctccagcctagaccagttggcaggaggtcaaagttatcttcatgcacatgcactgcagaggagcccctaataagtcttattcggggccgctgagttgtatcaagcttgtgctgcatgaaactcctttctggagatgcacagttcgcgaaagcatttaattatgcactgcgtcacatgtaggcctcatggttttcggctatgatgctgctcactggttcaggttctctgtagctacctctccccaaactgcctgagatggcatctgtaagagaaaaactgtttcatgcttctatgtgccactgctctgagaccacagcagagaaggtacttacctttgctcatagcagggcataggaccagttgggctgatagaatgtgaaattcttcttattggtgaacagtgaaggattgcattctacatgggttcctgggctaacagtacagtcattcctgagatctttccgtaaagaggcagacccaatggattttctaacaagtagagaaagaagaaacttgtttctgagtgagttacagatgtccagtgccaaacggtttcgcccacaagttaacagaaccctgtctcatcaccttctgatttcatgaataagaattaagtacttattggcaaatgtatgtaggttaattttctaggtcagtgaatggtctgccgattgcaacgttaatttaatcagaagagacatcagtataggttgtgtgcatctgctgagtataacagtgcccttaacacattgccctttcatgaacagtgctgaagtgtgtctaaaaatatttcttctttttacaaatgtatgtcttcactgagcttcgcatttattacctcccatcttctgttctctaggagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggractcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaatttgtgtttgcttgtggagcattgtgctgaagcgtgtgtggcagaaaattgtggatgtgggtccccctatgatgatggcacacacacacaaaaaaaacagctagtaggatgggacaggatttagagtggtgggtcccaaactgtgcattgaggtgcacagggaagtacaaaactttccatttgtgaggaaaacacagcaacatgtgcagacactgcacaaacttttactattaaattatttgaactttactacttaatgaacagaacaattatgtatttcttttggcttggggagtgctatgatctgaatgtttatgtctcccgacaatttatcccctcaccctcaaggtgataatattaggaagtaggacctttgggaggtgattagttcataagggcagagctctcataaatgagattagtgtccttataaaagaggcctgagcgagacccctcacccctttcgatgtgtgagattatgatgagaagacagctgtctataagaaagcaagccttcaccagacatcgaatctgcgggcaccttgatctcggaacttagcctccagaagtgtgagaaataaatctatgtttgtttataagccaccatatttatggtattttgttacagcagtctgaatggaccaagacacagaattctgaaaatgttactgatgaattaagagcatcatgtaccaagaaatgttgggaacttccgatttagaaactagctggaagttagaagtaggcagatttgctagtcagagactccaatataagcaaaggtcaaggaggggattggaaaaggcatagacagacaaggactacgaggtaaaaaaaaattccagaatggaaaaagagaagaggtcccatgttgagcaaatcatcaagatccaagagccacatggaactgaaattcaggaaaatggaatcattagtatcaagcagactttgatgcttgcagcagtcccctgcctctgccaggagtgttttataatactacctacaaaggagctcactgttccctaagaatgctcagctcagggcccagaacaggaagctagagaagttttgtttaaaccagtggctctcaaaatatgattcccagatttgtagcatggacaaaatcagggaacttgttagaaatggaattctcagattcccatctgtcagaaactctgggggctagggcccaacaatctaatgaatgctaaagtttcagaaccattgctctatagcaacaacacttcagggagcctccagttacctcaagcaatatcaagaaattttcacaatgtctttaaaatagagctaaaattaattagctttcctttttatgggagcttttcttttaaagcaatagtcatgggagatatgaaatagaaataggcacacacaaaaaaatctcataaatagtagtgtgacaaatccccaaatggtgataagcaccactctacaaggtacaaaaagaattaatgtacttcttatttctcctcccagagaggaaggacacaaggttaattttgaattcctttgttgcttttctaaccttatctccttgtcctcttgttttacagttttgttttatcaccacccacaatgtctaatcatgagctgatctgaatcagtaatacatatcacctcaattattttgtctatttttcccttagcctttgtcccaggaacaagcagcctttgaggagatacagaatttttttaccctttaaggttatttatttagtaatgtgacttacagagtcttgtccaacagaaaataattatgcagtaacatgtatatcatatcagttatgcattcttatataaatgttaataaatatattctgaaacagattaaaaagaaaattcctgtcagatacagcaacattttctctttccttgatccttaactctgaggcaataatcagctatgagacaaatgaaaataaatgaagccaggtaagtcggtcaggtaagtatcactcgatttttccatccaacaccaaaatttcattccttgtgtttaacacactcacagcttttttccatatattgttttatttttataattgtgttctcattgtgaatatgtttttatgcttctttttatagtgatataggcattttttattacacataatctataagcctacctttgccaaggctatataatatttcattcagtatagcagtttcaaagaaggggacatttgacactgtctggcaatgtctggagatatttttgatgattacaactggccagagggtgaggggtgctactggcaactactgggtagaagccagagatgccaccaaacattcaacaatgcataggacagtcctcacaacaaagaatcacccagaacacaatgtcaatagtgccaagacagagaaaccctgttcttacactatgggtcttataatcattttcctaatattggttttttgttgttgtttgtttttttgttgttgttgttttttgttttgttttgttgtttttttcttttttttttttttttttttttttggggagacggagtttcactgtgttgccaggctggagtgcagttgtgcaatctcagctcactgcaacctccgcctcccgggttcatgccattctcctgcctcagcctcccgagtagctgggacaacaggtgcgcgggccaccatgcccggctaatttttgtatttttagtagagatggggtttcaccatgttggccaggatggtcttgatctcttgatatcgtgatctgcctgcctcagcctcccaaagtgctgggattacaggcatgagccaccgcgcccggcccctaatattggctctttcgaatccttcctattacaatacaatgataaacatttatttgtgcagaaaagcttttcatcaggtttaggattattcctcaggaccaattgttgtgttatttgggggagcagatagtatgaacatttttaccttactactctttcactttccaaaagagttaggctgttgagacctccactggcagggtattagagtcctattgttccactcatgggttcaggtctctgctcaaatatctcctcagagaagcattctctgatcagcctgtctgaagtggcattccctcctctcacgaaggagattcaaaatatttagcagtaaccatcagaagagactgagtcatccgcaccagcagaatgtcagcctgtctctccgccactcccatcaggccctctttgtctctttatcatgctttatctttatccataacactccttgttttctgacattatatttgtttgttatttttccctttcattcgtatataagctccatgagaagaggagtcttgattcttttgttaacctcatatccccacatgtagaacggtgcctggcacactaacagcagtcacagtattttaggtgaatgaaaaaaagaatgcattgatttttacctaaaaggaaaatactctttttaatagtcctttccttgtaaacctgacactttataggcgatgttacttaacataataaatttactagttttggcaaaatatctgttcttagtttttttctttggtaacacctttgtaaattactccagttgaaaaaggaagttctaatgcatctccagttttaaatcatggagagcagttttgaaacctcaaaagtagtattaatcaggagcataatccatccctttagctacctccataaggactacagagtccatcatagttccaatatgatacttcttgagatactgtgacagcagcttcttcatgtaaaatcaatgcaaacatttaacagatgcatgttctgctcaaattatacagtgaaaatcttactgaattttagtatttcttatctgaaagcctcaaatctcttagtacctattatgacaggctatttctctaatacacaaaacttggaaactataatctctttactagcagataaatttaaaaatgtgatattagaattgaattctgcttacaaatagcgcatcagaaatattaagcatttattgaattgaacttaactctttagggaaaatggaaaatctgcacatttgtcaagataaacaaaacatgctttttaatattataaaccatgattgattattatcattcatttgctaattgcaacatattctggtacattagagatctcttcctcattagtatgatatgggtgtgttagggtggcattaaatgttaagacatataaatgtaagacactgcaccagttttaagaatctaaacatccttgacattaaattgtagttaccaagggttttttgtttttttttttaagaaaaacatttttaaaaaaataagatttggaagtgggagtaagaaaaactgtaggtgttaaattgaaacttcttgttacatacagaaaattatcagtccatcagctgtgacacattctaagcaggccacaagaagcacagactgaccttagagaactgctccaaatacgctaatttgaaatattttacttttgcatgagccattcccagtatctctcagatttctattatcttgcttcaatcctaggagagttgctttagttctgaattatccatacaaagagatgaactgatgcaagtaattgttatcctcattgctaatttatttaataaagccttgtagtgaaaactatcagcattaaagttctttatgaaaaatattaaaatagcaaagtctgttatagcaccttcaaggaagtaacttaagagacttaggaagttaaaactgtatgtttcctgggctttttaaagaatgttaaatgaaaaaagttccacattttgtctacatggcattctagttttatgtccaaggggatacataaaaagaatcaataaaacacctagagaagaaaatgaactgttaaaataattattaaggccgttgaggaaatattgacaaggccaatgagaaagattaactagggtaaatctctgtgtattcacagccactcaccctctagggaacctttctgcagcaaattatattttccaaaaacagccagacagtatctatcttctgtcctgtatgtgactctttgaaactcatcccattgagaagcagggtctatggtccctcctcttggatctatggtgaaagtgatgctatgtgacttccaakcccaagtcacaaaagaatcagtttctgcctgattctcttggaatgtttgctcctggagcagccccaccatgctgtgtcaaagctgcatagccatggaaagacctacatcaaagaaaccaaggccctggcccacggctccagatgagcttccaggcagaaccattttgtcagctatgtaggcaagctgtcatgaaatggattctccaactttgtatcaacacatctcaagtgacactacatggaccagagaccagctgtttgcactgagtcatgcccaaattataggttgatgagcaaaataagtgactactgttttaagacactacattttggggtagtgtgttacacagcaatagtaactagaacacttcctacacttcaaagcctaaaatgctagcaactcttatttcccagactgcttcgcagctagggtcctggatgaagtatgttccaccacatacagggagtcacaggtctggaaacacaatgttattttaccatgcattataatgtaatattaaatgatttatcatatatttattcatgctttctgacttgctggctaccctggaaatgcccttacacagatttagaagacagaaattcacagaagccctcttcctgccctcttggaccctgctggtaagaagattataaagatataatttttctgcaacagggttctagtacctaattttggaaccatggcagcaagggcagtagcttctgattctagcttcccaatcctgggaccctagctatgtgtatacactcttggtcttcgtgccttgtatgaagttttctttaaaatacctagagtggtttctgctccctgctccaaattcagcaaactggaaaagaatggtcta

SEQ ID NO: 12374 - DNA, 26359 bp, Homo sapiens
gatagtgtgaaattggcataaggatagaaaaaaataaactaatgtaacagcacaaagagtctagaaataaatccattaaacgttgtcaattggtctttgacaaagatgccaaaacaattaaatgagaaaaacaaaatttcttaaacaaatactgctgggacacctgtataaccatatggaaaagaaataaacctcaatccctacctcataccttacattaaaaaatcaattaaaagtggatcacagacctatatgtgaaacctaaaactataaagcttctgaaagaaagaatatgagaatatcttcaaaatttgaacatgggtgtttaaagaatttttagacaggacattaaaagcactaacaataaaattaaaatttatacattgagcttgatcaaaattataaatttctactcatgaaaagacaaaattttaaaagtgaaataccacagtctgaaaggaaatattcacaatgaatatacatgacaaaagacttgtatccacaatataaaacgaattcctacaaatcaataattaaaagacagtctaaatgaccaaaagacttaagcagacacttcacaaaagaagatatacaaatggccaataccacataaaaagatgttcagcatcattagtcatcagaaaaatacaaattaaaaccacaataacataaaattttactaaatacaattgctaaaattaaaataactgacagcaccaaatattggtaaagttgtggagcaactgaaactctcatacattgctggtgggagtgtaaaatagcacagatatgttggcagggctgtgctgaaatggggagagagtcatgtgaatggtctgtccagatcaggcaataagggagtgcaatttctgcacagaatttaaaaattataataaaattaactaaaaattgatctactttacatcatcacaatgcattcgcatttctaaacaatgtcagtgataaaatatgtctgtcttgtagggtgggccatttctacctcatcctcactgatgctatttactcaagagaaattaaaacaaaaatacatgtaaagaaatgtccatagcaattttatggtggaagactgaaggcaacccaaatgtccatgtcaggagaatggataaacaagttgtagtgtatttaaaaaatggaatattactcagcaagtaaaaagaacaaactattgtggatgaacctcataaacatattgagtgaaactagacacaaaagaatacatgttgtacagtatatgaaattcaagaacatggccaggcatggtggctaacacctgtaatcccagcactttgggaggccaaggtgggtggatcacctggggtcaggagttcaagaccagcctgaccaacatggtgaaaccctgtctctactaaaaacctcctttaaaaaaatgagccaggtgtagtggcacacacctgtagtctcagctactcgggagactgaggcaggagaattgcttgaacccaggaggcagaggttgcagtgagccaagatggtgccactgcactccagcctgggtgacagaacaagactctgtctcaaaaaaaaaaaaacaaaaaaagaaagaaagaaagaaaaagaaaaagaaaataaaataaattaaagaacagataaaacttaatctatagtgatggaaaccagaacagtggttgccagtggtggtggggatttactggaaaagaatgggaagaaattttctggaattatggaaatgttctgtatcttgattggtttgttggatacatgaatatatatctttgtaaaatagtttttcattttacctaaaatttttttttaattaccttcaacacttagctttcagctagctcctcagtggaaaagaggggcctctgaagggggcaggtggaggtaggggaggtggagctgaagatagctgctgctcttgtcagaagaacaggatctcaaactcacccactcccttactcagagcatgtgattgatggagcacacttctccttgagaagaactctgaggacaatgggcacacccttgtctgagcccgttacatttccagaaagctaatctactgaccctctatggatttgttacaaccataagtcttacataaccagtgctttaaattgtaataaactagatatctttgcaaacaacattcaacttctaaattttgagaaacaggcaaatacatgtaaaagttctcatttctgattttattttaactagagacggggatctcgctatgttgcccaggttgatcttgaactcctgggctcaagcaatccgcccaccttggcctcccaaagtgctaggattacaggcaggagccaccgtgcacagcctgagattttattttcaaagtgaactgttgcaggattgattccaacagcccttcccactggagccaatcacaccagagttgatgagggaagggaagagttagtggagaggcctcagccaagaggctcaaaatcaacgcaaggaagatgaggactgaaaagcagcttggagatttcagccaggtggaggtggaggaatagaagccagattgaggtaggatgagtgtagggagtgataaggaaatggagactgaattttcaagaggtttggctaagaagaarawaagataaacagggtatcaagtggaggaggacgtggggtcaaagaaggggtttgtttttgttttaaggctaatacgagcatgtttcagagctgacaggaagagctgaaaggttaggaggcgggggctgatggatgtctcaggtgtctgataggaggggaggggtggaatcctcatctagagagtggctggagagaaaagacagacgcctcttccgcggcgagtggcaggaggagcagtgggcagaagggcagctgtggatgggggcggatgtgctggcaggcaggagggcgttcttatgttgatagacataagccacctaaagccatggcttccagatcctcagcagctgagctgctgagaggtgtgcagcagtctggagagggcaggatgtggccgttgagagtgtggacagagtgacagagcagcagttcccaaacccgagtgtgcatcagaatcactaagggcttggtgggcacagaacacaccctgagtttcggaatagacatagaaagggtttgccttcctaacaagttcccaggtgctgctggggctgctggccgaggtccttgcttggagaatgactggttaaagaagccacagctgtcccaccctgcagctccaaggggaccgctttgcatggctgccaccatgcccctccaagaggaggtagcatgctggtcccaaggggcatgatggtatcactttcaccaacagaacttagcagtccctgagcagaacctggaaccagaaagggggacaggagaagctctgccacttgggtaagatgcaagaacagaacaaagaggattcaggtgctggcaggaatggctgttggactgagctgagggctcctggcccagagtcactctcctcactcccagtgcggactctcatttccctgtcacttgtccacaccctgtgtctttccagttcccacccaaatctcctgtcttgcatggagcctgggctgcaccacgaccgcattcaccctgctgtccttccctgagtccacaaaactcagtatgcgacatggacctcccgcagcctcctggctccccttggattattgactggctatactgtactccatcaaatataagatgctatcacttgtgaaagacattacttaatcactgccaattataattgtaaaagatatcttgattctcaagatgttaaaatgtgaagaaatgtgtttcttagaatccatggaatatggattcttgagcatctgaacaggtgatctgcagagcatggtgccccccaagacccattcaggggggtctccaaggtcaaaactattttttgcaacaatataagtcattatttgcccttttcactctcattctctcattagcgtgcagtggggttttccagagactacatgtgtgatgacatcgctttgatgcccaatggaatatatgtattcttgtgtcttaaaactttctgagttttagtttctaatatggtaaatgttgatagacataagccacctaaacaaaagctcttggggtcctgaaaccaaaaaatttaggaatcactgcactaggttgtacgcccagcacttggccggcattgagyccatggtcaagsgtaaggagaggcccgagggggatgtgcacagtgctgaaggtgcacaggaaagggacttatcccagccggtctgggaaggccttccaggggaagtggggtgctcgcctgccaatctcaggcatgtggatgcttcacccaggtggccctgtcttgctgaccagagatttgtgccaaaccagctctgcgaccctgggtttagtcatgctaccttctatcactattaacatgaggctaatgtgtaggtcacagaggctgtgatgaaaattaaataattgaatgcacgtgaaagaatgccactcatagaaggtttcacatgaccacatccttggtggctgggttgtgtcttgggcatctctgttttctgccacagagcttaacacaatgcttggcacacaggggtgcttggaaaacactgagtgaaggaatgcatgttgggggtgtggcctaagcaagacgtggagcttgccttctccagacaccaggtttcccatgggatctggagcaggtgatgagcggtagtccataacaccttcctctctggctctgtgccaaaccagattcctcctcgtctcctccaaaccatctgtcttcttccacctccccattccctccccccagttccccaggctggtggccttagcatcagttagactttcttctttccccacctgtctgtcctcaaggttgctaggttcatccaagatctgagccaagaggtccgggtctgggacgtgggcgctaagggcccaaggcagctgcaaaagacctgaaaggtgagaagagagatcagtggaggaccccggactgtcctcaagaagcggacggactcccctgccctccactggcagcccaacagcagaaccaaagcggaccactcagcacaacctgtgtgtgttgctgggcgctgtccctggcccagtctggaccaggagcaaagaggaaagattcagggcgttagtgccaagagcagccatcccagcaacagaagcccctgcttccccagtacccgtgatacttgggaggagcagagtcttgagtggaacccgagcctctgacacccgccctgggggtcttccctccactctcgccagggtcctcctggatgagtgagacaagggcagttcaggaggtcacccaataactgaggtcgcagcaacacgaaggagccagggagcaggggcggccttcccttctccactccaggcggctccagcgtgcaccccaggaccccccaggaaggttttgcaggaataaagaatgaaggcagaagcaagatggaggatgaaggaggcgtggatggcttcagaaggcaagacrgaggcagcagtttggcgcctgtctcaaagcctcctccccgcgccaaggacaggtcggaggaggggggcgtggggacaggtagagcggaggctccagcgtttctaaaggggaagacctgaagtggggcaggagagacgggtgagttgtctggaagctgcatttgcctggcaaacactgggttaacaaagacttgcgttgcggggatgctggccttggacagggaatgcgaagggattatgctacggagaacggatccgagcgtgacggctgaatgaatgagtgagcgagtgagtgagtgagtgagtgagcgagcgagtgagtgactgtgcgagcgagcggcagaaggaactccgacccgccccaggtgcggagcggcgcgcccggcaggggtcactgcgggccccgcgggcgggaagggggcgcaggcgcggcgggcgccggggccctcccgcggggacggggcggggagggctgggggtggggttagagagagggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggtgagagggtctggggctcaggcggtggggcgggggacccaggctcacgacccaggcgcgccccgtcggccctggggactgcccgaggcgcgtcagggccccagagcccggggtggagcagggttgggaagtctcgaatggttgcttatcccagaatgaggagggggcttaagtcccgtactaaagcggcagccaaaagctgaagtccgaagagtgggaggcgtctggttctggtcttcaggtggagaagtgctcgaggtctcttccaaaagtgggggccccctcgccgccttatagggggagggggctggtccgaagaagttcgaggaatgttggtgggggggtacgcgtctggttccaatcaactgggaaagccgcgagtcgagtccccaggtgggggatgggaggagggttagacgtagtttttccaaagtagggcggtgggacctgattggctggggaattgggggtgggggggtctggtaccaacgaagagggtggggccgttgatttcctccgaaattgggggctgcgagggacagaggatgtgctgctggcctgcaccggaattgacagaccagaaagtgatgaaatggaaatcagccagaaccgacggcgctgcggcctctggacgtcgggggtccgaggccgggtgcccccttcccaccccacgccctgccgtctgggcctccctgctcccctctcttttctccattcccagccyctcgctgggctgtcccccgaccccacggggagggctcccaactgccccagtgcccttgcatcctgggtccccgggctctgtgcgcgttcccccacccctgtcatccccctcccctaccccggcttcctccactttccctctggccgggggggagagaaggcatttccgccgtggaaaactgtctgagctgcgtgccttgtgtccgggaagggcccgcagggggcagaacgcgtggcgggcagggacagggagggagggagagctggcccagccaggttttattgtgcctggcaaaggtgtctacgtgggcgccgcccccagcggtcttgtggcttaccaagcccatgtcctccccgcctccccaccccgcattgaggcaggactgagaaagtctttgtccactgcttccccacttccagatgcaggcttctgaagagtcttcctgaacgcctagccccctccccaggttttgtggctcaggttcagtcttgcctggggcattaaggggcctgcagaggatgacctggaccctggaggagggggcgccggagagggccgtcagagttgggtgtcagcctgggcagagaccctgagtgaggaatgccaggagactgagaaccccctgcccttttatggtggtcactgcagcaaccagtggctcagagccacaagagttcaacaaccacctaggcgaggttgggggttgctgtgcaccccatgagagcagctccccccttttcatctgaagcttaggtggagggggcgctccatatttgaagaagatggttctgcagctttaaaagtttgcaaggggttcttcaagactccttttctttggaagggaagctgccctccactcagcctggggaggggcagggatgggggcaggaggcagcacgcttgcccatctcttttcctagccacctcttcctggagatatttgaggagggaggaccaggtcagacagtgggagggtgttattccaactccatcagaaggtcccccagattttgcaggagcggcacattctccagccgcagcctgctgatggcatgggtttgggcagtctgacagagacctgcatctcggggcataactgacatcctagcttctggcttctcatcaggctctgaaattgagcgtcctttcttccccctcacccagcatgaaatggaaatatcaacatcttcctgcgtgctgtttgtaatggccttgagcctgctgagtacctcctccctcaaactttgtcagttgggcagggtcccctccctctctaattggcaagggggagcttaggactatgcgatctggggaaagaattagaatcctggcatctttaggacagaactgcatgttagtaaactttcacagcttcccaaggccctggcgtrgtgcagagggactttaggtgttgcaagttggctctgcccatcacctgctagatttggagscttggaaacagttcacttctgcgggcctcctgttgccccacttggccaacccgcacatttcctccttacccagtttctggcaaggagccaggcctcstctcctgcccccagcagtgagcaggcaggaggcccatttctcagctgtagctcwgtgagccgagrgatggcagccaggaggctgctttctcagggcagggcgtgtagattttgtcccgtactgttgggaatgcccaggaaagcttattaaaacgtttcttctggctggcagtgaccccagaaccctccttggtgtctgaactggactccaaaacaagatttattttattttatctattttattttattttwtttttttttttgagacagagtctcacttttacccaggctagagttccgtggcacgatcttggctcattgcaaccttcacttccaggttcaagtgattctcctgcctcagcctcccaagtagctgggawtamaggcacctgccaccatgcccggctaatttttgtatttttagtagagacagggtttcaccatgttggccagactggtctcaaattcctgacctcaggtgatcttcccacctcagcctcccaaattgttgggattacaggtgtcagccaccacacccggcccaaaacaagatgtaaaaagtgatccgcaggaggagcactcggtgaacagatgattgtgcgttggggcagttcttgacctgtgtccaggcccagagtgagggcggggtgggggcagggtgaggcggcaggagcaccctctcggtgggcactgcccctgcttctgagcaaaaactgcaacacaaggaggattttgtctgtggacctgagactggaaggaagtgcctcagtgggccagggagggatgggggtgggggccagctgggcttccagctgcccggcctccccccctggtgttttgagtctgagataatgaggagctgggacactgccagcttgggaagtgggctggaccggaagcaccccctgggacagcaaagcactccctcccagcgccaactggatccctcctcccctttgggggcccaytggctggccatgcccctcttagcctgccccttctccccacaccctgcctgtgcctgcattcacacacacacacacacacacacacacacttatgcacacacatgcacgcacagatgtgggcatgtagaggctcacgagctggggctgtaaggggagaaaaacaagttaaatacaatcatcttcttacctctgtaattttctccttggcatttgcctttgattaatggtcctgtgtcaccccctccccagcctgcatacctggggatcagatttcagtttcctagtgtgtcctggtctcaggccctcgrcaggaggagctgggtctcctggagcggttgggggagggtcccgtgccagccaggagggcaaatctggccagcttagccctaccccagtgtcctgatgcccactggccaagagggcctggcccgaaagcactttgtggagcagcggccctgctccatccaggtccttccctgtggcagcgtggggactttcatggctgtcgtccattcctgggatttggcgccccggcaggccccacggtggcttctctgctttcctgccgcttctctctccattccctcatttcygctctcttctctcagcagtccttgcatgtttcaagaccgtcagcagattgccagtgaggatgagtttctcttagtgtggagaaaaaatgtttatggtgaaatcacagaggcacaacctggccagcccctctgtccaccgccccactctctccaagttccctctccccatgagggctcttccagcagtgagcttttgttgtctggagatgccttgactatcagggatggaagagaagagggaattcgcctggcccagccaagccgagagcgcatctgcacagatgctgcccgtggggcctgcagtctggaagggaggacaggagagtgatggggacccctgaccctgttggcagatggcatctgtgcctctggaccactgggctctgtgtgctcaggtggacagtgtttgcccactctcctctcccccagctaggctctgtcttgaacacatacaagacacacacactcggtgggtgccctggcctctgtggtctggagcctgggaaagaaagctgctgaggaccaggagagatgtgggggaggtgagatgagactgcctccccaacccccatcttccctgttctcagcctgggcctcaggagtgcgtttctggctgccgaacccctccaggcaggctgcaatctgcaatcatcgttaaatcggcttgcagttaatttggacattgttactgggggatggggcccgggagcrctcccttccagctgtgggggtctgccgagttaatgctacagttggctggtttccccctgaccattttggccctggctttggtaaatcatttaatgagtgcccctgtgggtctcagtttaagcctgcagggagaggcccaggcctctctcgggtccctggacttccggctcatgcgcccttcgctcagagagctctgttgccttggaaacaatatgcaatatttttctactatctaaatgggagcccccctcctcagatacctcactgtcagtaactgcttcctatggggagcaacatttttctgggtccccagcatgataggtggtgcggctggggtctcaggaaggtgggccattcggccatctttctagtgagctgggcaccrgggatcccaaggggccagggctctgggttgagcccaggctccctgatgccccactgtccccagacaggtgtaaataccccgagatcacaggctgctttgagggccaaagggacagtgagggttccagggctttggtgtttgagccttggtgttgattgggcacagtaggcagaggcagcgctggggcgggatttaggrgttctgcctctgtgtggggctttatggaggaaatgccttcgcctccaagcagggacatctgcgctttcctgtctactttctggtagcctgtaatgctgccttctgcacttctgctcataatggtgcctctgagggtttggctctgcaggctggagcggagctgggagggtggcagcgtggctgagcccgggtgtgtgctgggggacatcagcagggccatgagagagaagtgcccacccgcagtctaggtaaggtgggggatccccagccttcacagtgaggggtcttggcaggaacccctgcccttctcwgccacacctgccactgctgctcttcagctggggccgtggaagcctcaccttctcsctgctctgtcttctctaacctccctcggtggggcctccgagcccagcccctcccccaggacagggagacacgggacccagctcaagttctgcagaccagcattaaggcggaaaggcggaaaggcgaggctgccctttgccataaagctagcaggcctcaccttgtcggtgaatttgatttgtggagcaggccctcgggctctcccacgtagcgctttgacttttttttttttyccttttctgtctttctggttgttagcaatctcacaagctagtttccctggttttccagaatgcagaagcaaaagtctggccacaatgcagcctcaacagctgtccacagagtcagccctaaaaaggaaaggctcggctgataaagatctgctatttttatctagcacttgatcctttacaaagggcttttaggttctttgtctcgtttaatcccagcaaaacccctgtcacgcagagtctgtccacattttgcatgggagacccgagaagggggaggttgcagggccccgctgggcctgtagccccacttgacccctaaatacaatctgagccctggtgtttgttgtgtcccgagggcagatttcccagctgctgtaggcagcctggcctgtgtcagggtcagccacctttccttaagacctgctcaggagcgccagaggggcaggagggcatccctggtgcctggtttgcaagagctcctgggtggttcgatccctgggagatgccaacrgaaggtgtcacccccgtctcttgctgctcccgggagtccattggaaaaycaaagccatttagtcccaaccccctgtggccagcagctgttcctgagggccctgkgcactgtggccatgcccgtcacttgctggtgaccttggttagtgcccctgsctgctgaggagatgacagtgggcaggtggtccatatgatcacgggacccctaaagcagggcaaggtggggagaggccccggcctcctcatgggccaggcagtgcgggcagtggtttgacctcccacacccacccagcaggctcccttgcgggcagacttgagtgtgagggtgcaggacaggcaggggcaccccatggtgaggatgctgggggcctgctgacctgctcacgcatgtccgcagtgaagggggggtcctccagacattttctgtccttttcctaagcagggcgggtcagaccctcagctccccagggcccaggccccacactcccctgtgctctaaaaggrtgggaggtgaaacctgaggagcgaagcaggygcccccagggcaggacccctgtgctgtgctgagagatagggcctgtcctgagtcacttaggcctgaaccacccccctccagggggaagggagaaaggaaatctgttcccatcccagaacgcctggccggaaagggcctgagaggtcacttggtctgacctgctcattttgcagatggggaagccgaggcccagaaagtgctaagcaggcaggtagtggcagagccagaatgagaagcttcaggctctggggctggatcccctcctctccccaatactgcggcagtccgcagggactgacctctaacctcactcttggccgtatgtggacaccacggaggaaggattaaatggtgaacattggaggcagagactggccccggggcttttgcattatctccaagggtgagcaagggcccgggggaaggcataggaggtagggaggagaagagacaggaaattgaccaagctcacctggctggctctcgtcagtgctctgggtaaagcagttttgttgaattttatactcacacacctacgtccaccaccccacacatgtgtggcctggagatgggttaggttggcttcttggcagccctgcagctatgatcttgagcccaattctggctcccagagcagatttttccaggatccttctagcctggccttccggacagccacatttctctcctggcaggagctccctggtggatggaagcttccgggcttcatcctgtagctgttacaccacttgtaacagcctgcttgactgccggtcggtgcctgtggggggccagtgtggatcrcaggcctagagctccctggctggggacaagcacccatgcccagaccccatggggctcctggagcccctgcccccatcagtcacagcctccttggtggagttgagcagcctttacacagcctgcccacctcctattgtcctcattttagtctaccctctgcaccttggttttagagtggatcttgtcactccccagctcaaaagccttcccgggctccccatcgtccagagcagcagctcccagcctgcctggtgtgtctcaattcctacagagatttctaagtccctaaagtcaccgaggccaggtcggcacatcccctatcttctgtttgaaagaatataccacggtcacgrctggtataagcaagaggcctaagagctcagataactcaaaatgcacctgctgaacccactgcatctctttcggtggcttccaggtgtgtcttggtttctctttcgaggtgtgtctccttttctctttygaggtttgtctcggtttctctttagccaggacgagtccgggtgaccctggtgggccttcctttcccttctaggtgtcatctccttccctccctttcccccaagactccctcygggcccagccagcaggtgaagcctgacttagggaaggggggatttccaggggaggggccctggcccccactgacccagcattgctatccacaggaggagcagcccccacaacatcgatccaagagggggrgctcagtgggcggcgtgtgctacctgtcgatgggcatggtcgtgctgctcatgggcctcgtgttcgcctctgtctacatctacagatacttcttycttgcrcaggtgaggggcygggccaggtaggggcaaggcctcgagaaagggtcaygtctagagaggcatggagggaagtgtctgcaagggggcagcaggaagccccagacatgccctcaggtgggagcgagtgcccggccagcccacaagactggggtgccccctcctccttggggcctccttggatgcaggccagtcccacvtttagccccttgtcctggggagccaagcatgaatccgggtgasagcactgggcccgccccacagggtcaccctggggaattctcaccagaaactcagatctggcagaaactggaactgtgatccccctccacagctcagaccctgcacctgcaggtcacgctttaaggctgacctaactgtgcttgtgcatggacatttgggttaccaaacaagagagggagaggggtgggtacagagagtctccaccacctccttccagaagcaggagtgtgtccttgctgccaactatcatccccctccccgggggacctgggcacaaagctgggccaacccagacctgggagggagggagtgtcgctgtgtgcttggaaatgaaagtaggtaaattaaaaggataaacctacgtacaactcacagagaacctcagggtgacaaagaggtgggacttgccagtcatttatgacccaagtgacctcccactcctaagcgtttaactttgttgtcccccagtttttccacgatggaaattgctgaagagtttgcattcacggggctttccccttgaaagctcagctcacatacacccatcaccttcctttctgtgcagcatccccctgccccgccccactccctccatggcctgcgtccccctcgttccagggtcctgtgtgggaccttcccacaggcctcttcctgttgtggccctaccctaggacctgggccagcatttcctggtcccctctgttccaccctcgactcacacccttctccccacaccccaattcgttgtgtggacacctcccagcagcccctgggtctgtgccctgggacagtattcggggtgtccagccactgtgggatgcagcccyggagcctcaccttccctgggctctcatccccgcacagcccacaggagccccccatgctgcgatgacgcatcctccctggagaacttgcactgaatcaaacagacggtggaatcctgccgatcccaggccaggcagtcccaagcatgtatctacaggcccctccaggagccccctccagaagtaagagtgggcagactggcccgcccggccattcagttgatgggatcrcaccaggctgcctggcctcccttactgatggagtgactggactggcccaccagacacagtgtctgtcaaggtttctccaagacaggggtcagggatatccaggaagggcgatggcacttgtccgaggctggatgtggaggtaaccgtgataggggcacaagactcttaacagtgttgcctccagctccacctccccacccgccgtgttaggcccctccaggtctgcaggccaggacagcaggtgacaggaaaggcagtcgtgcacaggcgtaggtgcccaactcttaggttcgtccttgaccccctgccaaccccaggctctttctctggtgtctgcacctctgtggagggcacggaggtggccaggtcctagtcctgctgggccaccccttttcccagtcaccgactcaaggacttggaggccagaagggaccttagggatcatcatgctttactgatggggaaactgaggcccagagaggtctgccacctagaacctggcagacccagctcatcctcccttccgtttgtgaagctgggaagcgccttgcccaagaatcagctcatctcctcactggcagccccagaccctgacctgatgccccaccgtctcagtttctccatctgcgaaatgggtctcacagtccctgctcttcttgcttccgcaggcttttggggcaygtagcggacgggtaggcaagagggggccttrcggagtgcgtgtatgaccagcctctctgactgtctgtctgtctctccgccttgctcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcgggtgaggctggccagggcctgggggtggggggtgggagggtgtcccggggactcagggcaaggggagcagggatgaaaggagactcctcggagtacagcaggtgtctacggttaggcttaccagggtcttcaagacactgcttttctcctgttagcaacaatggttcttgctgagtatgaagcagccgaggctgattttctcctcagcctcctgccagctgcacgctggctgtcatggcaggrccagtgcgttgtatcgaggggtagtacattcaccatcgagtgcattgcgtgtacagctcagcgggtctctgcagagtgggtctcatgcgtattcatgtaacccccatgggtcctgagacagggcatctctcgctggggtccaggctgtcccaggaatggctggccctcacaggtttcataaatgcacagctgggatgttaccatgttccccaaacctcagctctgtaaacatgagaagaagctttataacaacagaggcgtttagcaatcagctgctattttcctctatcatgtggcaccttctacaacaggctaagagaagaccaggaaaagggagtgcccgcccaggtattgaggagtctggagaggactctgctcctgaaggcccagggtcccaggaaggcatggtgggactcctgcccctgctggccaagctgcttttttttttggagacagagtctcgctctgtcgcccaggctggagtgcagtggcacgatctcggctcactgcaagctccgcctcctgggttcacaccattctcccgcctcagccccccgagtagctgggactacaggtgcccrccaccacgcctggcaaattttttgtatttttagtagagacggggtttcaccatgttagtcaggatggtckcgatctcctgacctttgatccgcccgcctcagcctcccaaagtgctgggattacaggcrtgagccaccgcgcctggctggccaaagcttcttgcagccctgcctgggtcagctgtcacctcctgcagagactgacccaaccccttctcctgccagggtctgactgcgtaccatgatatctccctggacaagtgctatgtcatcgaactcaacaccaccattgtgctgccccctcgcaacttctgggagctcctcatgaacgtgaaggtgcgcagggggttggggggatgtctgcagcatcctgtccctcccttgccccctgtctcatggaggctaggtctgaggtacaggaagttcctgtgtcaggggttgggggagcaagagacattgctggcacctgggccctgtacccagattggtctcgcctctgctatccccctgcttccacatctccagagtcaatgccccgagaccggcttccttagtgttcaaggttgtaccctgggtacggactcgtgcgcatgccattgctcctggcagcacaggtgcaggcaccgggcacaggcaggaagtgcctgaggacatcagaagggccagcccaggggcctctggaggagggaggtgggctggcatttcgggcgaggggttggacgaaagcctgaggggccgactcactgtggcggccaccttgttttgcagagggggacctacctgccgcagacrtacatcatccaggaggagatggtggtcacggagcatgtcagtgacaaggaggccctgggktccttcatctaccacytgtgcaacgggaaagacacctaccggctccggcgccgggcaacgcggaggcgtgagtggctggcttcacccacagtagcccctgtcccgtgccccagaccacagttatcttcacgcctagcccagctgtcagagagctcagatagcagcagcaataacagctagcattagcagagcacttccgtgtgccgggcaatgctgtgtgctctttatgacctcttaagagtgtaagtcattctcatcctcattattatttttgctgcccattttaaagatgaggaaacaggtgcagagaggttaacaccctggaggtcacacagcagggaggtggcagacatgggcaggctgactccagctttcgagctctccccatttctcactgtgctctttgggtgaatctgggtgaatggtgtcacttcctggccctcctgtggctcaggctgaggctggtggtctttgtgactcagccaggatgcagggctcactggggtttttctktttcctcccagggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccrgctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgasccgtgggttctgctgagtaggtggagctcattgctttctccaagcttggaactgttttgaaagataacacagagggaaagggagagccacctggtacttgtccaccctgcctcctctgttytgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaccttgacttgagtgtggctggaggggagatgggtgtaggaggggtgctccgggcagggtcgaggagctggacctcgggagcagcaggcagggagaagcctgcagaccttgacatctggcccctaaagagctgggcatcctggattcagccaaggagtgtaggatatccccttcgtagcaccctggatctgagccaggtagagttcacactttccgggtgaggaggggaacagggctgggagagcttaccgactcgcccaaggtcgtgctgctttaagtgcctgtaaaccaccctgtaatgttctacctggcagatgacatcattattgcatgtccttaagcacaagggcggtgtcctattctccaccacgtctggacaatttgtaaccattcctggaggatctgaagtgaggtttggtgtgataatcacagggtcacattctccagagaattctggaagcggcaggagagctggccagagccatgtctaggtggaccccagaggtgggacctatatcctgccctggggaccaggatgggtgcccacctgcttggtgctgttaagcctcagtacccagtgagggccataaaatactcaaattagtgcagacacaccttgttcccagatccaaaggcaatcatgcaaagacatcagtttttttttttttcacatttgctgattgaaatgcattgcaatcacaattaaaatgccaactgaatttattttttaacttgacacaaataattctttcaggaaagtaaacagggaatagtcaggtagatcctataaacggtaaagaactcccaaagtgctgggattacaggctgagccaccgcgcacctgcccaagagatatgtttttacaggtcaagttagggttgaatgtttgtgaagcattttttttttttgagacggagtttcgctcttgtcgcccaggctccgatataaagcgttatacaccacaataattaaggagttcagtgtagcaaagacagagcccagtgcaacccaacagaggcccagacattgacttaaattacacggaaatttaatatatgattatggcggcatttccagttagtgggagacatgtgggtttgccttttttttgttgttggttttttttttcttctttttttgagatggagtcttgctcctgtcacccaggctggagtacagtggggcgatgttgtctcactgcaatctccccctcccgggttcaagcaattttcctgcctcagcctcccgagcagctgggattacaggcgtgtgccaccacacctggctaatttttgtatttttagtagagacggagtttcaccgtgttggccaggttggtctcaaactcctgacctcaggtgatcctcccgcctcagcctcccagagtgctgggattacaggtgtgagccattgcgcctggcccatgtgggttatttttaatggaacagcgggctagccattttgacaaaaaattaacctggattctacttccctagaacaacattaatgctggatggatcagagattttaattatgaaatgaaactatgaaagtacttgaagagattatttaaaaggtaatcttggaggaggaaaggcctttctaagcatgatatctaccaggaaaaaattggttacgaaaagttagaatttatatacagcaatgtataccacaaagccaagaggtttataagcagtaaacggaaatgtcttttcaaacacaggcataaaaagggctatttttttttaatatgcaaagttcttataaaccattgtgaaaaaggaacaacccaatagagaaatgagcaaataatataaacagttctagaaatcaaaactagggagatactttattttattttattttattttatttttgagatggagtctcgctttgtcacccaggctggagtgcagtggcaccatctcggctcactgcatcctccacctcttgggttcaagtgattcttgtgcctcagcttcccgagtagctgggagtacaggcgcacaccaccatgccggctaatttttgtattttcagtagagatggggtttcaccatgttgcccaggccagtctcaaactcctgacctcaggtgatccagctgcgtcagcctcccaaagtgctgggattacaggcgtgagccaccgcgcacctgcccaagagatatgtttttacaggtcaagttagggttggatgtttgtgaagcattttttttttcgagacggagtttcgctcttgccgcccaggctggagtgcaatggtgcgatcccggcccaccgcaacctctgcctcccaagttcaagcgattctcccacctcagcctcccgagcagctgggactacaggcatgtgtcaccatgcccagctaatttttgcatttttagtagagacggggtttctccatgttggtcaggctggtctcgaactcccaacctcaggtaattctcccacctcagcctcccaaagtactgggattacaggcgtgagccactgtgcccggccatgaagcatgtactgtatacaaaacactacgtgtaagtcagtgtgtaagttataaaatgtattaatcaacgtatctctggaaacccaccagccaacttatgaaacaaaagactaccaaataccactgagagtctctgcatgctcttctcctcttcctgttgcataacaaaccatcccaaaacttagtggcctgacacagtggtttattatttttcccgagtctgtgagttgcctgagttcagctggatgaccgaggggtccccgtgggataaccgcaccctctgctgtatgttcatctgggagctcagctgcggyccaagcaaccaagatggcctctcaccctccaagggcctcgctccacgtggcctctaaccattaatggtctagcccagccctccttacagcttgtcaattgagctccaaaagaggggaagcagaggctgaccatcctttaagacctggcaccacaaatcccagaatgttacttcattgcattctgttggtcaaagcaagtcacaaaaccagttccgattcaaggggagggaaagaccctgcagatggggagcagcttgcatgctcagggatgccaagaactgttggaaactcagacatcatccgagcactccccgccatccctctcccctcagtatttcatgggggacattaaatgcctgaattagtgcaaagacacacctattcttagaaccaaagacaatcttgaaaatatgtcaattttccataaattagccaatcttaaactctactaattagccaatccaggtaattcctatcttgggtttctctgttctgctttctaattgtaccatatatccaagaatccctgaggaagttttgcttggatctgaacactgtgaaagtggtaacaaaatacacatattattctctgacttgcttccccaccctccaaaccttttaagccgtgtccatgttgaagcctatggtaatatttcattcatttttactgttgtatattagttcattgtatgaatatacagcttaatacctatgaaacaatgactaaccatggctctttggatttttttctgattttttttttttttttttactatcagaacgctttcatgaacatttctttgatggggttcctggggcacctcagcactgggtcacacagtgtgcaaatattcaactcataaaattctagcagattgttttttgtaagacattgaaccaatttacacttccagctgcaccgcatagacattctactcgttccacatccttgtcaacacttcatgttagcaatacgttttttgccaatggataggaaataaaatggtatttcattatggttttagttgtgtctcctcgattactagaaaagtggggccggtttcacatgtttattgaaccctcaaatttcctttcctgtaaaatgccgacttgctttctttggcctatttttctattggttgctttgttttcttactaatttgtaggagttatttatatatttatacattttatattttacatattttcattgatgggtggtaagtatcttacccaagttagttcatggcttgccttctcaccttttttttttttttacaaacagcatcacgtgtacatagctttctcactttctttgtggtcactttgatgaacagaaattattgattttaatgcagtcaaatttattcatctttttccttgtggttagggccttttatatcatttcagaaatctttcccatcctaaggttgaagaggcattattctacaatttcttctattcattttagagttttgtattttacatttttgaatccccaggaatttaatccctggtctgatgtgaggtaggaataacgatttgttctgtttttgtttttccttccccactgagttacagtatatgtctgcaaggatcaagtttctctatatgtaaggtctacttctgggctttctgttttgttcatcaggtctatccgttggaccataaccacacttaaagtaagtcttgctacctggtactaaaagtttcctaccttgattctctccagcagtgccatgcctattcttggccctttttgttcatatgcattttagaaacaactgccaagtttcatggaaaattctgttgaggttcttttttttttttttttttttttgtgacggagtctcgctctgtcactcatgctggagtgcagtggcgtgatctctgctcactgcaagctccgcctcccaggttcacgccattctcctgtgtcagcctcccaagtagctgagactacaggcacctgccaccgtgctcagttaattttttgtatttttagtagggatggggtttcaccatgttagccaggatggtctcaatgccctcatgatccgcccacctcagcctcccaaagtgctgggattacaggtgtgagccaccgcgcctggccttctgttgaggttcttaatggacttatatgaaatctatagatccacttggggagaattgaaatcaggatattgagtgctctcacccatgaacatggtatttttaaaatctgcattgttaatgtcttccaacatagttttatactttcctcagtaggggtcttacaaatctttcattacattgattcctatgtcccttatatttgttgttatgatgtttaataattatacctttgttgccaatgtgtagaagtataatttatttttgagtattgatccagcaaacttgccgggctgtctttcttattccacaaagttctctgaggaaatttttttttttttttttttttttgagacagagtctcactctatcacccaggctggagtacaatggtacaatctaggctcactgcaacctccgcctctagggttcaagcgattctcctgcttcagcctcccgagtagctggaattacaggcccatgccactacacctggctaatttttgtctttttagtacagacggggttttgccatgttggccaggctggtctcgaactcctgacctcaagtgatccacctgcctcagcctcccaaagtgctgggattacaagcgggagctacagtgcccagccttgtgctttgtagacaagcaattctggtaactgattatgagtaaattttgtttcttccattcaaataattaaaacttttatttatttttcttgtgctatcttactgggtaggagctctggcaccatggtgatagccacaaatcttgttttgttcttgatttaaaaggaaattcaccttgaatatagtttagctgtaaatattagaagaatactctttgagatttaagaagttctctattcttagttttcaaagtgtttttatttttaatcaaggattgatattaaattgttttatcaaatgttttttctgcatctattcatatgtttgcatatctgttaatgtggcgaatattgctaactgatttagtcatgaggtattttcttatatctatgctactggattccatttgctaacattttgtttaggaattttagatatatgttttt

SEQ ID NO: 12375 - DNA, 17903 bp, Homo sapiens
ggtcacccttggacactcagtccacagtctctcttcaaccctcctcacaattctataagccacttagcccccatagtaaatccctgtctgctcacactggttatggtaggcttagttctctgtaggagctctgattgaaaaaaaaaccctggcatgacagagtatgaccaggcactcctctgggggtggggggtggggcctgcagctgttctccctgaggcctgtatggcaggaagaaggcagcacaggaagaatcctttaggtagggagagctgcacgtgcaaaggccctgaggtgtgagcagccaggggtgtcttggccagggaggaagtcagcgggtgctgaagaggagggacagaggagagtggggcgggaagagccactggaccatgtggccccatcccttcgagtctgaagatgagggagggggagggggccaggagaaccactggaccatgtggccccatccctgcgagtctgaagtctcaagggctaaagtagcctttagaaagcagatatgtgcagagcccatggtgcctggccggagcaaagcccttggtgtgtgcagagcccatggtgcctggccggagggaggccctcggtgtgtgcagagcccgtggtgcctggccggagggaggccctcggtgtgtgcagagcccgtggtgcctggccggagggaggccctcggtgtgtgcagagcccgtggtgtctggccggagggaggccctcggtgtgtgcagagcccgtggtgtctggccagagggaggccctcagtgtgtgcagagcccgtggtgcctggccggagcgaggcccttggtacatgtccgtgagtggacaagcaagtgtgatgtgtctgggtgggctggcaaacacaggacttttcaggtgggttttcaaatgcgcagcagggtcccttgggggagccagaaactgatcctggagtctgggtgctctggaggagacggccgctcccgtgggtgggtactccgcgtctgagtcagctggtgtggtgtcagcagatgtggccaggagctccatgctgctgggccaggcctgggtgcctgtgccgcgccccagggaggggctgtgggcaagccctgaaagagccgttgacatgccagaccctgagggcccccatgccagaacccatgcagaaaggtaaagaaggcctctcccttctcagctgggacccctgccccctgaagggatcttgggttctggggcccggggcagggccacagcctgaggcgaaacagagcagggtggcagttaggggaggctcgccaggcattcctgtatgccgtctgctccacgcggctcacaaacaaacccatggaaaccccacacccgcctgctcagatccaatttaagcagcacagactccacccccgatgcctgactgggaaaggagcttcacagcacctgcggttgtccaaaagtccaaccttagcaacacattttggttaagacaacttttaaacattgccaacaccctgggagtgtgggcgccgattactcacactgtggtctacacttacccaaccacagcaggcactaagggggtgtcaaagacaagggggtgcctgctggggccgtggcagggcagccaggtggagctggatgtggacacaggggctgctctgcccagctgcagacaggcagcagccactggctccagccacagccttgagccacactctcctgaaaaccaccttggggcaagtggctcaagtgacctccaggaaggccctgtcctcagaggaccctggcattgctgtcaaccaattcactaaacactttactgaataagagaatccaatctacaaaatgtatccactccaccccagccccctgcaaccttgggcctagtggggtcactcctttgtccccatctctgagatgcaaggaatactcaccttgtggttaatgaatgaatgaatggtgtgaatgaatgaatgaagtgtgtgaatgaatgaatgaagtgtgtgaatgaactgtgtgaatgaatgaatgaactgtggatgattgcatgaatgtactgtatgaatggatgattgaatgaatgtactgtgtgagtgaattagtgcatgaatgtactgtgtgaatcaatgtactgtgtggatgattgcatgaatgtactgtgtgaatggatgattgaatgaatgtactgtgtgagtgaattagtgaatgaatgtactgtgtggatgactgcatgaatgtactgtgtgaatggatgattgaatgtactgtgtgaatggatgcttgaatgaatgtactgtgtgagtgaattagtgaatgaatgtactgtgtgaatcaatgtactgtgtggatgattgcatgaatgtactgtgtgaatggatgaatgaatgtactgtgtgagtgagtgaatgaatgaatgtactatttgaatgggtggatgaatgaaagtactgtgtgagtgaatgaatgaatgtactgtgtgtgtatgtggggggctgctcctgcctgcgggcacagaggaactcttctgtgtgggtggggggacaccttgcaaagtgctggtgtgtgagttacacctatggatacttatcctgtgaccctcagcagaaggcaggatagagacttctggttcacagaagagggtctgagagccaggggggtttccagcaagactctgagagcatggagtcacacaagatcactccgtcactggcctgcagtccctgcctcagtgcagaaacagctctgcctgagaccccagcccgatccaacccaaggggccacaggatccagaaaattaagcccacctggccccagttctcccatgtccccctctctgagcacagcaaagaatgctcccatgtcccctggtgccctagggccttcgcaggcgtgcttttggaggggcctcccactaccaaaggaagttcctcctggctgctgtctactccagccctccaaacaagccccctcccttcccagacaaatcagctgtggccctgcctggagcacctccaaggcctcggtctaccaccaccccacatcctagctagagacccccaggcctaggcccaccactgccctacatcctagctgaagcccccgaggcctgggcccaccactaccctacatcctagctggagatccccaggcctgggcctaccaccacccacatcctagctgaagcccccgaggcctgggcctactaccacccacatcctagctggagaacccccacccaggccagggcccaccaccaccctatatcttagctggagactccccccacacagcctgggcccaccaccacccacatcctagctggagaccccccagcctgggcccaccaccgccctacatcctagctggagaccccccagcctgggcccaccgccaagtgggggccccaggtcgcagagctcactgagacggcatgagggccgggctgggagaacagctcctgctgcccctgggctgttccgcagcctccttggcctcctgtgagactgggtgagcctggaagccgctgccacggccagagctggactgagatggggactgtgcctcagcgagtctctggagcggcaccctggcttcctacacaggaacatgccccagacccggcgcctccttcctctcctcagacccagagccagtagctttgccatggagcctgtgctcctttcagccgaggaagctgtccagaaagcgaggattgtccagggatgcagagtagctgcagtacagccgccccatgccgctctgggaaaaaggcctgtggattcgagtccagcctctgagcagcggctgccagtcctgctctggggactcgtggagggcctgagatccttccaggcagatgatgagatcgaagcccattgcatgagggcaccttttgctcccatgctctgatgggcacacggcggctttcgagggctgcaggccagagcaggcacctgacaaggctggtaacatacgcagccaaggctggattttcttcatagacttcaaccaacagcacatctcagcagatgaagtgctggagccgatatgggaatccagcttccactaagccggacaatacaaagattcgcaccaacgtagaaccacgccacttttctcaggcgggtttttcatttttaaaagtatgattgcttttcataaaacattatgctatttatgttaatgtgtaatagcaatattttcttatttttaagtgaattggcaagtattctgaacatttctgttatgatttagaaaatgataagtatccataggtataacccatacaaacaaaaaagttcttcagtgtcctcaattagttttttttgtttttgttttttgtttttttgtttttttttttttttgagatggagtctcgctctgttgcccaggctggactgcagtggcgcgatcttggctcactacaacccctgccccctgggttcaagaaattctcctgcctcagccttctgagtggctgggattactggcgtgcaccaccacatccagctagtttttgtatttttagtacagatggggcttcaccatgttggccaggctggtctcgagttcctgacctcaagtgatccgcccgccctggcctcccaaagtgctgggattacaggcatgagtctcactctgtcgcccaggctggagggcagtggcacacacagttcactgcaggcttgacctcccctggctcaggtgatcctcccacctcagtctcctgagtagccgggaccacagacacagtctcctgactagttgagaccacaggcgcactccaccacacccagctaatttttgtatgttttgtagagatgaggtctccctgtgttgccaaggctggtatcaaactctgggctcaagtgatcctcccgcctcggcctcccaaagtgctgggattacaggcatgagccactgcgcctggccctcagtgacctttaagagtatgaaggagtcctcagataaaaacatttgagaagcacggaggtggaaatttgtctttggcctgggggcctggagtctaaatactgcattgagtggctgatctgtggttttcgcttaaaatacaggttagatcatttgtttctgtttgcattctgtcctagttgcttctatttattttttctctctttttgaatctgtgaaacattaacagggttccaaacatcagagtgttttgtctaagcttaaaagccctctgggtgattccgatgagcagaggccgggaaggattgagcaagaccatccccgagctccttcctccgctctgtttccagatcccatgactggggacctataaatattttcctgacatggagcaggatcaacttcagcatctgttagcttcatcccaaaggcagggaagcctagagcccctgggagggctctgcaccgcacacaccgccggcctgcagccccagccctgtgcggggtcctggggaggggggccccctttctgtggctcttcctgactccctgcgcgttccaccccagaccctcagcccactctgacctccctccaggagggatggcttgcaaatgccctctggccacagtgcagaccgctaggctgttctgtgcagctttaggccatgccaggaaagagacttaaagccagggccccaaaggccagggatgcctgcgccgggagccaggagcttccccagccacttccagcatgtagactgaagtcaggccacgcacagggctctccaggtcacaccctgcgcaagaaggtgtagcacgctggctctaatttcgagaaggtgaaaacaagagcccctctgcccccacgccctgagctttcccgaaaggcttggggcaaagaactcccctcagtggcacctagggaggcaccaggaaggcgcttgttggaacgggagagaaacggggagagggaggaggacaggggggaggggaggaggggaggggaggaggggaggggatgaggggaggggaggggaagggaggggacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgagtactgcgtgcccccgggacacccagagagggcccgggcctcctgcactttccccgcggcccagaaccttgtggcacctccagagggacccycaggactggctgcgaccgagctttaagggtctagtcccgggggcagccagtcggccaaggccccrggtccctgcgacggcgaaggcatcccggaggccgcacccagaccggcccggcaagctgcagggactcggactgaaaacctgcccgttacccctggtcgctcgcaggcgcacgggcgatctaacccygcgccgtccattccgctgatgggggtctcggaagcrccgcaggagagctttgcggagcagggagggggtcgcgggtgctcggggccgtcctcagagcccaaagtgccgcagccctctcggctttccaccccgaggctgccacgacggtgccagcgcgcggctgctcccctctgtgctcccaggtgatggaaaaccccagcccggccgccgccctgggcaaggccctctgcgctctcctcctggccactctcggcgccgccggccagcctcttgggggagartccatctgttccgccrgagcccyggccaaatacagcatcaccttcacgggcaagtggagccagacggccttccccaagcagtaccccctgttccgcccccctgcgcagtggtcttcgctgctgggtaagtacagccccctcctcgcctcctgctccaccaggaggrctgcggcgccsgagccccccgcacagctgcacggcggcgcttcccagtctggggcgtgctgacgtcgggagactctaacacyagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgmggtgttttcggcgcccgccgtccccagcggcaccgggcagacgtcggcggagctggaggtgcagcgcaggcactcgctggtgagcgcggggccggccgggggcggggtccggggggccggggccaggcgcgctgagccgctgtcgccgcaggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggccgccccttcctggcctcggtttccagcccgtgttccgtgggatgrctgagaggagtacatgggaccctgtccccaacagtggtgcagagggcacgctggacgctgggcagtggccccagtgaggccatacgcataccagaaggtgggcttctcggaccccaggccaacctcctcttcttcctccccagataacgtcctcctctcccagccacccggccaactccttctactacccgcggctgaargccctgcctcccatcgccagggtgacactgstgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcctagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtrtggccaccgggtgacagctatgctgcagggcacctgtgggggtctcgggacccagccaccacacagctcggggctctgctcacaggcgccttggcctggggcggggcaggtgctgrtgagcattctcctagctcttccaggcacctgctggacagggcaggctgggaacgctggggccragtggcagttccctccctrctcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgtycgtggtgtgcaactggtctggcgggaagagcccctcgtgggcagagggtccagagaggtgcggtttgccccacatttgggggcactgggccacagtgggcaggggagcacrtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggmtgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggygttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggccycttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcragcgttcacctcggtctcccctttgcttggtycagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctrgggccccccggagccatggggtgtcgggggctcctgtgcaggctcatrctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctytaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtccctggctgtccccacacttgttctgggccccgtgcagtgcagggacccgtggtgtgcgctaattggggacacacattcagaaggcgcctggtgctgccgtcagggccatgaggcacgtgctctgtgtgtgtgtgggaggcaggcctgagacctacagatctccccacaacagacgccacccctggcccatacaggatttcagaagacacagcaaatggcatgtcagatgcatccacaaacccggcaggcacgcgcctgcccacaggacgatcagaagctcagacaaggggcaccttgagatccggacgaggccccagaagccctcactctgccccctcctctgtgggagcagcttgcattgctgctgttcatgggggggccactgaccaccaagaccctcgcagcccatcaggccaccagcagacacctcctgagacctgagctcagaggccccaacctcaaagatgtcctcaggggctcactgtaatctgtcgtggccctttctgcagcaggggtccccaggcctccccaccagtgccactcacctggtggaaccccagggccctctcagtgcctgggcgggagctctgtgtggtttgaggatggagatgcttgggggatggctgcttcttcagtcctctcccagtgactggaaggtgggggctcacttctctcaccgaggcctggtagacgacccttcctcgtaactgtctaaggccctccagccctgatgcttctagaaccagaccccaggcccagctcccaccaccctgcacgccatccccgcccaccatccttgaaaacaatgaactaagcccaagctcacgggcgcatgagctctgaggtgacgtggagatctgaaaaacccctggcttaaagttttcttaaggttcctgggactgacaatgccaggaggcccctgaaagaatggccgtaaatcctgtgtagagatcacactgtgtacttggaactcaagaggatccccaggaacatgaacccacaatcagaacccataaaacgcacagaacaccagccttgatgctcctgagtcagagcacatggcaaactccacggtcagagccaccgggccgctggggctggcatgaccaggagaagatgctgaccgagttaacctcgccaggagctctaaactcaaagacaccagagcagcacaatggggtggtgcattgaagcctcgacagacggacacaacactccagtcaaagggcagagactgcaagagcagactcacagaaccatgcgctactgtggagcctgtgaagtcctgtaggatcactgaaaggctggggaaggggttgtggtgcagactcctgcagacacctggatccacctgccctccctcctggagcatggagctgggggtccctggggtaggacaggcgtcactttggggccagaacatttactgcccaggtgagaggctattgtgctttcctggcctcagggaccccagggcatgtgttgacgtgggtgccatcactgaagtctctggggccccagggcatgtgttgatgtgggtgccatcacagaagtctccagggccccagggcatgtgttgacgtgggtgccatcacagaagtctctggggccccagggcatgtgttgacgtgggtgccatcacagaagtctctggggcccccacgccactaggacggccactgttgtgctgaggcattgagatttgaaggagaccaatggggaackccatccggtaatggaatgctgtgtgaggaatcccacaggggccgcctggccggagggtggatcagacaggacctatgtggctgccctctcctgaatgaggtggggagcacgggaaggcgcagagtgcagaaacagcactgcatcagtggccgccatcttgacagcagtgagtagtgggtatagacaggaaaatggagaggagaagcccctgcaatagtcccaaaagagagaggtttgggcctcagagacacccgtggacatgggaagaaatggatgagtctgggtttgttttgatgaaaacgcaacgtgaatacttacagacctgcgtttaacatgcctcccagagatacccaagcagttgaccccatcccagtttcaggaaggccttgtcccaactgggtcagcatggggagccaggggggcagtgagcaagtgagggcaagttcacacctgagggacccattcgtggtctgtagccccctgcacactgtgctgccacaggtggacggggggcacctgggccagaaggaggggctccacaactacactgagactgcatgcccctcatattagtgggatgtggatacgctgggctccagggtgctgctgggcctacagggtgagggttggtccagcccactgtgctgagaagtggtcggcagtccacagtgtccgagccataggaggataatcatggaatggcccactgtgctcagcaacaacacacaggccatggggactggggctgaggggtctgtggcactgggggaggaagacaaagggtagaacatggagaagcgatgggcagggagttcctggcaaagatggtaggctgaggaactgagcactgacacctaactccactcccaccatactccattggagctgtagaagagggtgtgtggatggcacaatccagacgcctaccttggcactctcaggggacaccctccacccacagaatggcgaaacgggatggatacagctctgagacactgcccctttcataagatgcagggaggactccactttctacccccacttctaaaaataagtaaacacacacattgaggctggagcaaggaggtggtgtcaggccaaagaaacaagctcatgagcagctgggagagacagggctcctgagggctgctgtgagcttggctagcagcagagtgaaaaggtgaacccagcaccccacatggagagggaccctcgaggccagcaatgccctgtgatataggaaaggacaggagcaattctctcctcaggagctttcccagtccctagtgtgagccccaacaatcaaaatcaggcaacgagcacaacacaaagattaaataaacaagaaaacaagtcgctataattgaaagccagaaaaaaaaaaccaacagattcagacacccaagatctcagataattaacttgtcagaaatgtaatataaaacaaatagaacaaaaatgaccaaccaacaagggaaattagaaacaaacagatacatttggaaaggaaaaattataaaatgaggaagcctgagtgagttggagagctaattagcatagctgaacaaagaattagtgaactggaagatctagctgaagatatcaggcagaatgcagcacagagagacaggaaatgggaaatttcacaaagatatggaagacaagatggaaagttctaaaatgttttaaatcagagactctaaaggagataatagggagagtggagaagagataatatttaaagagaaaatagtgcaaatttacagcactggttaaaattagaagctgtctccagaaacagaaagcataatgtattccaaagaggagaagtgaaagcagtccacgcccacrcacagtatattgaaactggtgaacactaaacacaaagaacgaaccttcaggctgggcgcggtggctcacgcctgtaatcccagcactttgggaggccgaggcaggcggatcacgaggtcaggagatcgagaccatcctggctaacacgacgaaaccctgtctctactaaaaatacaaaaaaaattagctgggcgcggtggcgggcacctgtagtcccagctacttgggaggctgaggcaggagaatggcatgaaccccagaggcagagcttgcagtgagccaagattgcgccattgcactccagcctgggagacagtgagactccatctcaaaaaaaaaaaaacaaaaaacaaaaaaaaaaaacaagaaaaaaccttcaaaggacccagaggaatgtacagattgcttatgaaggaacatctattgaatgacagctacttcctaacagcccaaagggagtcagaaggcagtcagataataacttttgaaatgttgagagaaattaactgtcaacccacagctgggaactcagcaacaccttttaagaatgagagcaaaatgcagacattttcagattaacagaaactgaagaatcttaataccaagataattaccctgaaaaacttctaaaggatgttgttcagggtggaggaaaattatcccaaaaggatggtctgagatttgaggaatggtaatacaaattattttaaatctctccaataacaaaagtataaattccccaaagatggagaaaaaaataacagcaaaattagagaagctgaaaagcagcggtaaagtgagagctgatcagcagggccgaggaaaacaaatcctaagctggaagttcaggttcacaaattcaaataactggccggccacggtggctcacacctgtaatcccagcactttgggaggctgagatgggtggatcacttgaggtcaggagtttgagaccagcctggccaacatggtgaaaccccatctgtactaaaaatacaaaattagccgggagtggtggcagatgcctgtaatcccagctactcaggaggctgaggcaggagaattgcttgaacccaggaagcagaggttgcagtgagccgagattgcaccattgcactccaccctgggcgatacagactccttctcaaaaaaacaaaaacccccaaaaaacaaacacccaaattcaaataactgggcaaatttttaaccacagaatgtttaaaagcacagggaattgtcagttccaaatacatttattactagattctataatgtcatagtataattttggtataggataatgctgacctcataaaatgaatccaagtgctctcttctctgactttgtgaaaaatggatattaactttttcataaacgttttatagaatatttcacagaattcaccagtgaggccattgggcctagaattttctttgtgggaggagtttttaattacaaataaaatttatttattcgattctttattagattgattaggctattaaaaatattttttcttgtgaaagtttttgtaatttgtgcttttgaagaatttgtcaatttcatctaaattgtcaaatgtattggcacaactcattcacaaaattcttttagacagggtatccctctgtcgtcaggctggagtgcagtgacacagtcactgcttactgcagtctcagccttctaggttcaagccatcctcccaccttagcctcctgagtagctgggactacaggtacccccccaccacacccagctgatttttattgttttgtagcaacaaggtctcactatgatgtccaggctggtcttaaactcctcaagtcatatccatcttccttagtctcccgaaatgctgggattacagacatgagctaccacactggcccataaaatttctttattaccctcttattatctgtagaatttataacgatatcccctttcattctgatattggtaacttgtggtttttctccttctcccctgatcagacttaccaattttattgatctttcaaagaacgagttttagtttcattagctttctctagtgtttgttcattttgtttcaatgatttccacactttacttttactttttcttccatcaatctttaatgtttccttccttcttactttaggtttaatttgcttttctttttgtagtttattaaggtagaagtttaggtcatggattttaaacttttcttcttttctaatacaagcattttttttttttttttttgagacagagtctcactctgtcacccaggttggagtgcggtggcgtgatctcagctcactgcaacctccgcctcctgggttcaagcaattctcctatctcagcctcccaagtaactgggactacaggcacatgtcatcatgcctggctaatttttaaatttttaaaatagagatat

SEQ ID NO: 12376 - DNA, 36255 bp, Homo sapiens
  misc_feature (1)...(36255): n = A,T,C or G, or insertion/deletion polymorphism (see Tables 1-2)
atagatagaaagaaagaaaaagaagggaggaagggaaagagggagggagatgtgacctggacttcaaatataaggaagcacaggaagacagaggcactaggggaaggcagggccagggagcgggaggccaggccaacaggaggttatgtgggggccaccatgggaaagccaggtttcccttcttgaggggagtggaagagaggtactgatgacacaaggattcctctcccagcagagtgggaacccacaaaggcaagtgaagtttaggtggggtagaaaggaaagaactttctgaacatgaggttagggccaagtgcgtggggagaggtctgtccctgaggaaatagggggacaggagctggggagctcagaagctcaagaccagcctggaaacagggggacagggcagggagctgcatgtggagaagaaggtcccacaagggtaaggggccttgagtcctcaggacatttttgccagagcaggtgctcaggttagaggcccaagacgttcctggtggaagggcctacagccaacggaactctgtggttgggttcaagttaaagccaggggcaatcccgggggacagcagtttgcagtagggagggaaggggctgtcctgggccaatggatgatggggctggcttcacacaagctagcagaggcccctcttcctccctcgcctgctgctgtcacaggtctgctgactcagctgactcgggacagctgtgatgggtgatgaagggctgacagagcgagggacagatggctccctaggagaggcctctgccccatccctccctggtgcacaatcatttcttgccacagtttcagagctttgtgagagaccatccctctgtctcccctggcagtgggtagaaagtctggtgtgtagtttgttggccaggtgcagtggctcacacctctaaccccagcactttgggaggtcaaggcaggtggatctgttgaggtcaggagtttgagaccagcctggccaacatggtaaaaccccatctctactaaaaatacaaaaaattaaccgggtgtgatagcacacgcctataatcccacttacacgggaggctgagacaggagaatcacttgaacctgggaggtgggagttgcagtgagccgaaattgtgccattgcactccagcctgggcgacagagtgagcagagtgagacttcgtctcaaaaaacaaaacaaaacaaaacaaaaacaacaacaacaacaacaaaaaaaacaggccgggtgcaggggctcacgcctgtagtcccatcactttgggaggccaaggcaggcggattacctgaggtcaggagttcgagaccagcctggccaacatggcgaaaccctgtctctactaaaaatacaaaaattagccagacgtggtggcacgcgcctgtaatcctagctactagggaggctgaggcaggagaactgcttgaacctaggaggtgcaggttgcagtgagccgagatcgtgccattgcactccagcctgggtgacaagagtgaaacaccatctcaaaacaaaacaaaacaaacaaacaaaagtctggtgtgtagtttgtctctgtttttccggaaggcattccactagttcttctcaggttctcctagggttaggctgggagctgaaagttgaggttggttttccccagcctctagggcacagtgtcccagacagcagcatcctcttccctctgtcccacccaggtggtgtgcctctgtcccactcacctgtcctgccctgccctgttccggaacctttgctcgtagtatctctggttgtgtcacggctctgcctaaaacccttgagtgactcctcatggctccttgaacagaaaccaaatgcttcttgatgcctggaaagatcaggcccctcctacctccccatccccagtccctccattgtttcccagggactccctcacactcaccttctctctctgctcctccaatgtgactgaggcccaggcagaccattctgtgtcctgttgacttaaggaaattttagtggaatttctagatatttactcaatctttacagaatatgacaaagagagagagcattctttttaatttttttaatttaaaaacagatatggggtctcactatgttgtccaggctggtcttgaacttctgggctcaagcaatcctcctgcctcagcctcccaaagtgttgggatcacaggtgtgagccactgcactcgaccaagagggcattcttaatatgcagcacaacagtaaaaagaaaaaaaaaagaaagaaagaaaaaaggactcttctatatgtatatcatacttcaaaaaatgttacccccaaaatggcaatatcctcttcacagatgtccccgtctcccagagcccagccctctcccttccaccttggctctttatcctgcactcagccacagtctctttagctgtctttcagcttgatccattcccccgctgcccagattctgcccccaagagagcccaggaggtgaccaagtacacaggatacacaggtgaggttgggtgtgggggagagtggttgcaaacacagtgtgacatggcttctttccaccctttctaatctccaccaggcccttcttatctggagtgtacatttgctattcctcctctggaacatcctggcccctttcctccctcctcctgcaggccccagcttaggtgacccttcctcagcagtggaggtcccagaccaggacagtctcctaccccgctctctgagctcccaccataattaaacctacaggtttatttcacagctagactgtaaactcccacactcgactgcacgctatgtaaatgggcagccactgtgtctgctaggttcacggccaaattccaagtgccgggcccacagtctggcacacagcaggctctcaatcaatatttgttgtagctgctattcaaaccttactcattctttacaggttgcgcaaagcctgcctctctgcaaacatctttggtctctcttctctgaaaggcccgtgtcttgcccatttcctgtccatatgtcttcgactaccgggcctaggctgaggcacaatcccccgaggtcccggctgtttatctgctgaaaacctttttccccagcgcagatggatcaccaaggactccctcacactcactttctctggttctctggatacctctggccgaccttccccaccccactgggtcctttcctcaatttgccttccttagcgggagcggccggcgtctgttcctcccctacactctccctcctccaccaaatgtaacatggccctgcttaggcttccttcttcagcacagagcctgggagccaagcttctcctgttcccagctggtcttctaccctccccgttaggagagactggacacagtggctccccgacgtctccaaccccacctccttccttgatgggcctggagggccctgagatcaccctccctcccttttaccaacagaaaagccgaggccagagaagaatggatgctggccaaggccatatgatgtacacagagccaaagccacagtcccctcaccccgtcccgggccactgtggggacctaagcagtcgttccacgggagagggcgacccctggtggtgaggaggggcatggcagcctgtcgctcatttcctgggcccggaggctgacggtggaaggggcgtggcctggaggaccaccgacccaggctttagttatcaggaaggtaaatgaaggcaaggcccgcagagcgaaagaacgtgggaagttaggacaagttttgctgggctttgcccttccttagccacattccctgtaatgacctaacaacactgctctgtgactttaactgcaccctgctgattgctggttggatcttcagggagcaggaatgggcattcaacagcttttggcacactgcatgtcccaagggtcattactgacttgagggtctggtgcgaagccctggaatgcagaaactcacattctgataataagatttctaataataagagaatgggctcagtccgggcacggtggctcatgcctgtaatcccggcactttgggaggccaaggtgggctgatcacctgaggtcaggagttcgagaccagcctggccaacatggtgaaaccccgtctctactaaaaatacgaaaattagccaggcgtggtagtgtgcgcctgtgatcccataatcccagctactgaggctgaggcaggctgaggcaggagaaccgcttaagcccgggaggcagaggttgcagtggaccgagattgcgccactgcactccagcctgggagacagagcgagactctgtctcaggaaacaaacaaacaaacaaacaaacaaaacagaacgggctcttattaaagagtccagggactgagtcaatagctgtctccaagtttctatggtacctatctctcctctctaggggcaaaagggctactcaacaaaaggctgattgttttaacagaaacactcagaaaaccaaacctttgagaacttcccaggcagaaataggcatgcttagagaccacgcgaccagttaatatgaaccccacatctgctatcaagagaatctgggcaatctactttgaatatcccttttggagctgtttctaggtgtttagagatcaaatgaaatatttctaggaagtagctcgcctcgaactaaccacacaagaatgaaatctcactgacttacaaggtcatggctaaaccttcattgactaggtattttcctccttccttgatgatccagtatgtagcagtatatgcccagatcaggaagtgtaaaagctgaaaatggagttggagacagaaagtccaatgtgttgctggccactgtggtgtcactgctcccgatacaggtgtaacctgagtctcccgcttgggagccagaaatcagctgagaagaggcctctggaaagaggctgccctggcccagaagggtggatgaagtagggcctcagcacagctcatcctaccgagcaggccggaccctgagttcctggcttgcactgaagggtctgggtaagtcccttctgtagcgcctcagaagctccttgggcaacctgggaagttaggacaagagctctgacatttgaccctgaggtgtgaggagagtgctttgagagagaggatgctgaatgcgagcgccctggttattacctcctggcagcctcctaacctcaccttgactctgccatgtaaaattgatgcctgggcgcagggcgccgacgatggtcagataccgcggcctgcacaccctgggacctacatccctgacctggaggacccaggccttccccgggcttcaccacgagtcctgccggccacacagggaccctaacagacctagtccagtctcagggtctgggctgctcctccttccaggaatgggagtttgctctaggcgatggaggaagggttcaggaggccactctgcctgcttagcaggctgtgggcccaaccccccacccaccatcttcatctcccacggccccaacctcgtagggagggcagggcggggctcaggttcgcagagaaggagggctcggaccagcgactccagggcagaggggcgcgtgcaggggtggggagctgggtttgcgaggagagaaggccatctcttccccagcagggtagcccccacctagctaccgggatcccaccctggctggcgcaatctttgcgtccggatcagcacccaaggccccgcccaacggcccgctgcctgccgggatttgtagtttgtaggggaggggccaaaaggcgcgcgcgcgcgcgtgtgtgtgtgtgcgtgtgtgactgtgtgtttgtgagactgtgtgtgtaagtgtgtccgggggtctgttgtggtgctcccgtccccgagggccctccggacctgggctcagcaaaggcaccacaggccgcagcttccgagaccccgccccgcggcccactgcctgctgggatttgtagttcttaggggtctagggcccaggctggggccgggttggggccttacacgcgtcctggcgtgtggctctcctgcgtcctcgtttttctcgtgagccctggatctggacagtgggcccggcgcgaggccctcaactccggctgggctcccggtggcactttctgccgaccctgagatgtacccgccacgcctgcgggactgacctctaggtgggcaaaccgaggcacaaagaggggcgcgctctggccggagtcggccctcttgtgagaatttgggctgggagacccagcccaggcctggcaggcaaggctgggtcaggcgagggtcctgggccctttcggtgtaagagtgtgcaaaataatgaacaggcctgcccaggactggctctgcacattagcgctagttaccttacaggcttgactgatcagatttttatttggcaccactacagaggggagcccagggagggaggaagtctctcgtgaccaagaaaacctatggtccaccctggcctacaactctgctttaacgacaaaaataaaccgagtttgggagggggtgaggaggaggggtgttttgtaaactgtgaagtccaggttatgagtgaggtgttattatcatcaggatcagacctcaaagcactggaggaaaggtctgggccttcaagagcctcacctcaaaagggagggtatggccgggcgcagtggctcacgcctgtaatcctagcattttgggaggctgaggcaagcagatcacctgaggtcaggggttcaagaccagcctggccaacatgtcgaaaccccatctctactaaaaatagaaaaaattacccgggcgtggtggcacgtgcctgtaatcccagctactcgggaggctgaggcaggagaattgcttgaactcaggaggcggagtttgcagtgagccgagatggtgccactgcactccagcctgggcaacagagccagactctgtctcaaaaaaaaaaaaaaaaaaaaaaagagctgagatagctgtttgcatgtgaaaggactcacaactggcactagcatgcggtgatagtggggagggcatggactcccactacatggctcccatctatcctctgccgcttactaagtgggacctagaacaagtgattttgacctactttatctctctttatctctgtttcctcatctgtcaaaggaggataataagaggatccatgttagagagtaaatgcaaggattaaatgagaaaatcatatcaaggatagcacctggcatatagtggcagcacacaatagtgttagctgttatggtgttgagtacccagtgtgacgctggctgtacaggggtaaacttgtcttctgggggactagtccccccatcccaggcacctggtgccctccccaggccactcatgctgtactggacagtcccactttcccaagaagtcacaaggaattccagcatgtcactgttctggttgcccctgagcacctagcagtgatttaagaaaaggcaaaaccaaagttttggttttgagctttattcggaaaatatggccacccagacccctggccattccccagggcctgtgaggtgatccagaaaaattcatttgcaaatcaaatttaatggctagaagcatcctgaatcaatgtcttcaaataaatatttggggccggtgaggtggctcacacctgtaatcccaacactttgggaggccgaggcaggcagatcacctgaggtcaggagttcgagactagcctggccgaaatgatgaaaccctgtctctactaaaaatacaaaaaaattagctggcatagtggcgtgcgcctgtagtcccagatattcgggaggctgaggcaggagaatcacttgaaccggcgggggggaaggttgcagtgagctgagattgtgccattgcactccagcttgggcgacaagagtgagactctgtctcgaaaaaagaaaaaaaaaggaatatttgggggaattttgatgttagaattgagcattgcaaaagatccctgtcagtcccccgtgatgaggaaatgcaactgctcagcctgagctgtgcctctcggttggagttagaggagccagaagggacccttcgagtctagtgctttcattcacagatgggaaactgaggcccagagagggccacatggcagggtagttagaagacaggtcgagaacttgctaggaagaatcttttgcaatttcagaacttctcagcactggaaatgagtccataccccgagtttatgggcacagaagcagaaagctgattgtcctggacatccccagaccttggccagagtccaagcagctaagcccagaagccagtgtccagtgcttctctctcctgggtttcttcagccaggtgttcatcctagaagtaggagtttattaataatggtgatggtatcttgcattgtccaggccttcattctttttgcggatcctcccggctgggcacagtggctcactcctgtaatcccagcactttgggaggccgaggaaggaggatcacttgagctcaggagttcaaggctgcagggagctatgatcatgccactgcactccagagcctaggtgacagagtgagaccctgtctcttaaaaaaaaagaaaaaagaaaaaaagcagcctttcattgaatcctcacaaccttccaaggtaggaggactggggcttctgttctcgtttcacagatgaggaatctgtggctaggaagtcttaagggattatcccgaggcaacagaatctgggcagtattagaatgtgggggttttgctgtctaatctgttaatgcattcagtaaaaatttttttgagtgcctattacctgctgggcgctatgcagggtgctgggattgcaaggatgacttgacacggtccctggctagaggtgctaacattatggtggaggaagcacatggtggggagggaactttctggtgtgatagaagtgttttatatcttggtagggatgtgggttacatgggtgttgcatctgtcaaaactgatttaaatgtacacatgatttgtgcatttcactataaatttgacctaagcaaaacaaaacaaaaactgaatgctctggaaggactatgcctgggcacaaccttggagaggcctagttgtctggaagcaggccaggttgcccatggatccaaatccacttttgctatcgggtgtgcctgagaagtgttcccatgggcgtgtagatgcaggtggcccagtggcttgatgtccagaatacctggggagcactgcagagggagtttcagaggagggatatttaagctgagtctgcagagtgagcagagttggtcaaaggaaggcagatagtaggcagcgggaggtggtttccgaggactccttgctggagtgtgcttgtctgaggtcacccagatagaaagattgtttccttaccccaggccccacccatggacttcagagaaactcattctggttgggattttcgaagctgcctcccacaaaaggatcttaccactgtgtcacaaggccatggcctgatcctcatgctctttgtcaactgacatctctcatgggttggctatgccacattcaggagccaaggcggaagtgtggacccatcgctgtccaacacatttccagaaggcctggcctcctggtgcagatgcttgctggcctgttttcctctgaataaagaagagaagggtcaggtgttgcaggtcagatcagcctgggttagaatcctggttcagcagttgggtgcggtggctcatgcctataatgccagcactttgggaggccaaagcaggaggatcacttgagcccaggagtttgagaccaacctgggcaatagagtgagacacagtctctccaaaaaaaaaaaaaagtttagctgggcgtggtggcatatgcctgcagtcccagctactcaggaggctgaggctggaggattgcttgagcctgggaggttgaggctgtagtgagctgtgatcacagcaccgcactccaggtgccgcgacagagtgagaccctgtctcaaaaaaaaaaaaaaaatcttagttctgctactgaactagcaatgtgacactctggacaagttagttaccctctctgagcctcccaaagacttcatgtttccagcaggaataatgatagtagatgtgaggacgcaccaagcacatagtaggctctcacagaacagtagctgttcacagggtgattgaggccgggggcctaacgattgaatggaagtgaacactgcaattctctcgcaaagtttacagcacagtaagcttgtccttagcttcccctataccctccttcccacgcccaattctaggaccctttcgggcgccccagcctcccayaggggctccccgccagctcagaccggccgggcccctccctctgactcaccggrggcggctcctggccgcgcacctccagggggcggggggcggctgagacagcgcccagggcctcggagcaaggcgttggcaggcaagtagtgcgcttcggggtccggtcgccggggacctgggctccccatgtaggggtcgaacgggcttagccggttcgggggcgccccgctccctcctcttctcccacagccggggtcctctcttaggggcgcgccgtctcctggcttcctgtaagaaaaggcgggagagggtgggtccgtgctaaagaaatactttattttacttcatttgggacaaactaagcagtagtgctcaggggagaccacaagggtaggaacactgtgcgtctggtaaaaaaactagttctagagcgtcgttaccagataactcattagcatgtgcattgagttcctagccgctcccgagagtcctaggctgagcgaccggcccttttgtttcgctgttgttgttgtttgttttttgagacggagttttgtttttattgcccaggctggagtgcagtggcgagatctcggctcaccgcaacctccgcctcccgggttcaagcgattctcctgccttagcctcccgagtagctgagattataggcgcccgccaccacgcccagctaatttttgtattattagtagagatggggtttcgccacgttggtcaggctggtctcgaacttctgacctcaggtgatccgcccgccacggcctcccagagtgttgggattacaggcgtgagccactgcgcccagccagttgtttcgctgttaatgtgtaaacctctccccttttttcctgtggtgataggagaggctttagcctagacagctgagtgtgaggaacagtgattcccattgatccttgttccctccgtgggtcacagagtccagaacttaagagccacccaaggtatgcgctgttgtgaccaaaatctatgaagctttccagcgctggggctggggatggaaataggagagtgctctgtggtttaactttctttcctcctgtggagaaaccgggagctaggggagtggccaggcacatttctacctcaggtgctgatggcacattgcaaactaaagggaagagaaagaagtctgggtttatcgagcatgtattatttgctcattaatcataggatctcatttcatcttcacatttaactgtatgcacgtgttacagattggggcacagggaggctccaggaggttaagtcacttgcacagctagtaaggagccaaattgtctagctcttatcactctaccaggttaaccgcccagcctgtggttttgtggggactaggccctactgggattctcacccagactatccttttttttcttttttaaacttttaagttcaggggtacatgtgcatgtttgttatataggtaaactcgtgtcatggggctttgttgtacagattattttgtctccccggtattaagcctagtacccattagttattttcctgaatctctccctcctcccaccctccaccaaactaccctattattattgttattattattattttttgagactgagtcttgcccagtcacccaggctggagtgcaatggcgcaatctcggctcactgcaacctctgcctcccgggttcaagcgattctcctgcctcagcctcctgaatagctgagattacaggcatgcgccaccacccccggctaattttttgtgtctttagtagagatggcggtttaaccatgctggccaggctggtctcgaactcctgacctcatgatccacccgccttggcctcccaaagtgctgggattacaggcgtgagccaccgcgcccggcccatattaccctatttttaagcctggcagtttggccatggagacacttggatgctagctacaggccatgttctttggggagaagatttaacttcccgtcttgctctagtgaaattttatcaatttcgtttcaatgagaaacattcatccagtattgctttttttttttttgagatggagtcttgctttgtctcccaggctggagtgcagtggcgccatctcggctctctgcagcctccgcctcctgggttcaagtgattcttctgcctcagtcgctccagtagctaggattacaggcacccatgaccatgcccggctaatttttgtatttttagtagagacagggtttcaccatgttggccaggctggtcttgaactcctgacctcaggtaatctgcctgcctcagtctcccaaagtgctgggattaccggagacagccaccatgcccagcctatccagtactgtattttctccagacttttcccacgcagtcaaataatgaggttttgtttgaaggtctgctaattaggaagatttgttccagattttgctccagggtccccaggccttgaccctgaacctggagccttgtctcaagccagcctgctgaccaatacctttccaggacaggccggctaggttctgggcagaggaactacgcttgtgtggctgcataactgggtgctcactttctcctggagcctcatactgagtccgctcatccttcccccagggattcagaagggaatgggagcctcccttgcaggggcttccactccctgtgtgtttgtgggcagtctcttgtgctctcaggacctcggtgtcctccagaaagccagcgagttggaggagacaagctctagggtctagtgactgtgatgtaggcaggatagttgccctgggtcaacccaggatgggctgtctctcagagggcccagggcccagaagtcatgatgataaacatctggtgaatgagaagcagaccaaagggtagagacctgagaggcatcagcatggcatgcggaagatggygaagaatgttttatggcctcagccattccctgagaactgagcttagccaggtgcagtagcccacgcctgtaatcccagcactttgggaggccaaagtgggaggattgcttcagttcaggagttctagaccagcctgagtagcaagactctgtctccagaaaaaataaaaaaattagtcgggcatgttggtgcaggcctgtggtgtcagctgctcaggaggctgaggcaggaggatcgcttgagcccaggagttcaaggctgcggttagcggtgataatgccacggcactccagcttgcgtgacagtgaaccctgtctcaggaaaaaaaaaaaaacaaaaaaaaccaaaaaactgatcttaaaaaaaatcaaatacttgcattcagggcaaggagaaagacaaactgagggaggaggaaaaagtaatgtgaagccagtgaccctgcccagaaaatgtgactaacccagcagcggtgggggctgtgcmgcgcctgccccaggccctgaatggagaacatggctttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggcctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagaggtaggaggaagaaaggaaagtaggagtgttgaaaggtgaaggtggcagggtggctgccagcgcggctggctggtaccctcctgggtgggcaggcgagggctggctgtggtggcctgggaacagagacccacatttctggataccacattgtgccagggtggagttcccccagcctgctgtcctgccagccttatgccaggctccaggcacctgatctgatggcagctgtgaagctgcccgggaggatgggtgggctgtgcccatgctgcacatggaggaactcttgggtcagggcttgtcccagctgtgccagacctcctgacggaggccaccacactgctcctgaaggccctcagccagactggaggtgaaatcagattagaagctgcctgtccccaagacaggactgtggtgtgatgctatttgggtgggagtggcttggggagggggcagggcagtcctagccatttgaattcaaatgcaagtggcacatttgattattttgcaaactctggaagaccttggctgagggtctaggtggactgtctgaggtaggaggtggggagggaggaagtggttgaccctggggaagggtaggagacctatttggtatcaggggaaaaaccatttggaatccccaaatgaggcctctggacctagattctgagaatgccatgtcccaggctgggagattcagtttggtttcgagggtgggcacctacctccaccaggagaagtggaggtgctgtttcatttcacacctaggggcaagcagggactgtgaagggaagagacctattgggggtcagtggaatcagggtctgaggaaggcaaaggtaccactggaccccggcaggatttttgtccctctgatggctgtcaagtctttccttaaaggtgtgtgtaacggtgacctcctctccgaggtcccccagtgtgtcctcaaagacagcctaagtcaggaccatgggacagccagcaggacttgcgtcctcccctcccccagccccatggcagtctgggacccctagcccctgctctctgcctcctggggctgctccagcctgtcccagccttttgaaatcctgggctatcccttaggtgccaccccagtctaataatcagagcccagcaggtccagttaatcaaatgcattctttgagcacctgcatgaggttccagctagatccagaggcaaaatacacttcctgccctaaaggaccctacagtgtagtagtggaggtrggygggtccataactcaccacactatggcagagtggggaaaagtaaaggctttaagaggtgtagaagaggctgtttggtaaggtggtgagtttcccatcactggaagccttcaagaagaggatggtaagggatgctatagaagagatttctgcactatgcgtgtatgggtatgtgtagggcggtgcaggcagagcaggactagataagaactttagcgctttcttttttttgttttattcctcccccccggccccagctcccctcttcaactttagcactttctaatgctgacatctgtgattctgtgacattccccacttagaggaagttcgtctgcggtttcactgggtatggtggctcccttgttcactgcaccctgcagctaaaccataaaacatgggctattctttgtctctgtgcatgtcacccccagtgccaagcccccagcacagacgttgagtggaatggaatagactctttgctgggctgcttgaggaacagaggcatcaggtgtgtccttgctccagttgagatgtgaagcagccagtttatgctataaaacaggctaaagtatgtgctcccaggggagagggctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacctctgcctcccgggttccagcaattctcctgcctcagcctcctaagtagctgggactacaggcacgcaccaccatgcctggctaattttgtatttttagcagagatggagtttcaccatgttggccaggctggtcttgaactcctaatctcaagtgatccacccgcctcagccttccaaagttctgggattacaggcatgagccactgtgcccagcctaggatgagggggctttaatggatgtaagggtgaacatggacactgaggaagctcaaggagctgtgggcttggacagagggctgggataggggaaagaatgaaaggccagaggtcagggtggacccttccccaggagagactggaacaaaaggtctcgggacagagatctaatgaggcagcaggagtttcaaccctgaccaagcattagagtcatctggagcttctcaaacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaacctccacctcccaggttcaagcaattcttgtgctgcagcctcccaagtagctaggatgacaggtgtgcgccaccacgcccagctaatttttgtatattttgtagagacaggatttcaccatgttgcccaggctggtcttgaactcctaagctcaagcattccacctacctcagtctcccagtgtgctgggattacaggcatgagccaccatgcctggctggcactggggtttttcaaaagcccccaaatgattctaatgtgcaggtgagcatttgacactgttctggacagaattcactggcactactaccatcactttgaacatatgttcaaaatatgggtgatcaagccccattccagacctgtggaatcagaatccccagaccaggggcttgggcactgttaaagaaaaaaaatatggcccaggcgcagtgcctcacgcctgtaatcctagcactttgggaagccaaggtgggcaatcactggaggtcaggagttcaagaccagcctgactgacatggtgaaacctcacctctactaaaagtacaaaaaattagccagatgtggtggtgcacgcctctaatcccactacacaggaggctgaggcaggagaattgcttcaactcaggaggcagaggttgcaatgagctgagactgtgccactgcgctccagcctgggcagcagagtgaaactctgtctcaaaaaaaaaaaaaagaaaatttctaagtaggaaacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggattcctttttttttttgagacggagtttcgctcttgttgcccaggttggagtgcaatggcatgatctcagctcactgcaacctctgccttccgggttcaagtgattctcctgcctcagcctcccgaatagctgggattacaggcatgagccacgaagcccagctaattttgtatttttagtagagatggggtttctccatgttggtcaggctggtctcgaactcccgacctcaggtgatctgcccgccttggcctcccaaagtgctgggattacaggcatgagccactgtgcccggcccctaacaggattcttgctgaatacaggccagagtgatcagacatcactggggcggcgggggcagggtgttgaggaacccaatcagatatccacgattatcagatcgaccagatatcaagggtagggggttctaggtaaatggccttagcagggttcttttgctaaaaccggattttacaagcacacagatgggcctacggggtggttcagaagcctagttaaagtttggccaagcaaagaatctttgtcagtaccgacattttaataaggtcccaaggtcattctaatgagcagccaaactcctttcttttctttttttttttttgaaaccgagtctcactccattgcccaggctggagtgcagtggcatggatcttggctcactgcaacctccgcctcccaggttcaagtgatttccggataatttttgtgcttttagtagagacggggtttcaccatgttggccaggctggtttcgaactcctgacctcaagtgaactgctcaccacggcctcccaaagtgctaggattacaggcgtgagccaccgcacccggcctgccaaacccctttcatccaaaccctgatgtggctctctggcatgtaggctgcctgattttgagttaaacacagaatgaaaaatagtaaaggtgacaattggcgcactccgtgtctcattcttgagcgctccctgatggcttgagcttggggcagccacttcaccagctcaggcctgagtcacaggctgggctgcctgttscaggggatgtgggcacagcatgtgatcctctgtgggatggagaaacgttaaagtttccctccgcaaacctctgctctctgcatgtcctcttccggaatcgtggtgccaaaatatgccttccactattttgtaggttgggaaaggaaaaggaaagtcataattcacacagcatttcacatccattatcactgcccttgacctgtccctctttgtttcctactcagacttaataccttctgctctgtcatctgccttccccctacccctgacttccctggcccctgcgaaatattgcacttcctgatcctgctgccccagcccccaagaatctcctaatggtgccagcttgcatttttaccctccaattccccaagcccttaccctgtgccactggggctcatcttacacaaactctgtccaaatggatgcacagcatgaattgtattatgtacgaagtgcatgctggctctgtgatctctgcattttgagccaaaaaaagaaatcctctagtgatgggaacctatgaaagcgacagtgagtggagccgtagctgttgcattttctgaattttttaaaaagataatatctttttaaaaaatacttgcgtttagcattttttcccttgaatgacttttgtccagaaaaagtgttcatcattctggcatttgagggaagctgggcatacagaattgatagctgatgcctgggagtgggtgaaatttctcagggagggagtttagaattagagcagccattaaatataatgttaggtgaagggtttttgtttgtttgttgtattttaatagatgcctttttaacaggttaaggaaatttctttctattcctagtttgtgggtaaaaaaaaaattttttttttttttttgagagggggttttactctgtcatccaggttgcagttcagtggcatgatcttggcttactgcagcctctatctcctgggctcaagcgatactcactcctcagcctcctgagtagctgggatctggaattacaggcttgcactaccacatttggctgatttttatttattttattttattttatttttttgagacagagtcttgctctgtcacccaggctggagtgcagtggcacaatctcagctcactgcaacctctgcctcctgggttcaagcaattctcctgcctcagcctcccaagtagctgggattacagacgcatgccaccatgcccagctaatttttgtattttagtagagacagggtttcaccatgttggccaggctggtctcgaactcctgacctcgtgatccacccacctcggcctcccaaagtgctggaattacaggtgtgagccactgcacctggccttggctgatttttaaaatttttgtagggttgtggtctccttatattgcccaggcttgaaaaaattttaaactaggaatgaatgtagaattttgctaaatgctgtttctgcatctattgaggtgattacacatacatgtttgttaatagggtgtatagcattgattttcaaattttggcctgtttttttttttttkgcgttgtgagcggctttatttatttattttaaatttataattgacagataataattgcacatacttagcaggagcagtgtgatgtttcattgtacatatgcaatgtatgtgtatatattgtataatgatcaaatcaaggtaattagcatatccatcactttaaacatttatcatttctttgtgatgataacattcaaatcctctcttctggctatcttgaaatatacactgcattattattagctatcatcaccctgattttcagatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgggttcaagcaattttcccgcctcagcctcctgagtagctgggactataggcacgtgccaccacacccagcaaatttttgtatttttagtagagatagggtttcaccatgttggccaggctggtctcgaactcctgacctcatgatccacccaccttggcctcccaaagtgctgggattacaggcgtgagccacygtgtccagccaaattgtgttaatttttgtatgtgtatgttcatgagagatactgatctgtaattttctttttgcataatatatttatctggttttgttatcaggagaatgttggcagcataggatgaattgagaagtgttctgtcatctctttttttgaagattttgtgtacaattggtattatgtcctttttaaatttttggtagaaattaccagggaagccatctgggcttgggttttttggcgggggaacgagttttttactacaaatttattttctttaatagatatggccactgttcagataatctgtgtcttcttgaatgagctttcataatttgtgtctttgaaggaatttgcccattttatataagtggttgaatatattggcataaagtttttataatattccctttatccttttaatatctgtaaaatctatggtgatctcacatctctcatttctgtattgatatttgtgttttctctttctgttaatcagtttgtctaaagatttatcaattttatcggtttaaaaaaacaacttgccaggcacggtggctcacgcctgtaataccaacactttgggaggctgaggcgcgtgaatcacctgaggtcaggagtttaagaccagcctggccaacatggtgaaaccctgtctctactaaaaatacaaaaattagccaggcgtggtggtgtgggcctgtaatcccagctacttgggaagctgaggcacaagaatcacttgaactcatgaggcagaggtcgcagtgagctgagatcacgccactgcactccagcctgagtgacagagtgagactctgtctccaaaaaaaaaaaagccaacttgaggccaggcatggtggctcatgcctatactctcggcactttgggaggctgagatgggcaaatcacttgaggtcaggagttcaacaccagcctgggcaacatggcaaaaccccatctctactaaaaatacaaaaattagccaggtgtgatggtgttgcctgtaatcccagctgcttgggtggctgagaccggaggattacttgaacccgggaggcggaggttgcagtgaggcgagatcgcaccactgcactccagcctgggcaacagagtgagactcagtctcaaaaaaaaaattcattgctcttctctcttgtttctgttttctgttaatttctgcttttattttaatttctgtgagatctcagcagayggaagaccctggcccaggggtcagagaccttatttccatgaaccactcactagctgtgtggccttggactcatttctgagactcattttctttgtctgcataatggaactagggctcctagaggtggagtagttgatgaatatgaaagtacttggccactggaaagggcctctccagccccacgtgagagktcctttttgtggcatttgtaataataatggcttcttctttctttccagatctgaagacagcatrtacacagccattccccagaggtaagctgcatgccccatctcctttcacaacttccccttctttacctccaagggctgcccctccccactgctctcctcatccccagactgcagtcgccaggcctgcccagggctgtgcttgggcaagtgggtccaggctgctgtcaaccctctctcttctcgcagtggctctccattcccaggctcagtgcaggatccaggcctgcatgtgtggcgggtggagaagctgaagccggtgcctgtggcgcaagagaaccagggcrtcttcttctcgggggactcctacctagtgctgcacaatggcccagaagaggtttcccatctgcacctgtggataggtaaggggatctggatgggggaaggttgggcccaggaaggggagggagggggctggtatggatcacaagggccttgccctgccctctcccacttgtcccaggccagcagtcatcccgggatgagcagggggcctgtgccgtgctggctgtgcacctcaacacrctgctgggagagcggcctgtgcagcaccgcgaggtgcaggrcaatgagtctgacctcttcatgagctacttcccacggggcctcaagtaccaggtcagagcccacctctaggcacccccaccctgcagcttccctcagagccagccctgcttctggctggttctcaccctgcagaagacccgggtgccyttggagccgggtccccacctttctgcccgtcttccagtgggatggggtgcagagggctctgggtctcctgtcagtccactcagatgggccgtctgggctgcaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccaggtgggtaggctggccagactgagcactccgtattggcaccatcctttataaggacggaggggcaggaggccaggaaagagggagagaagctgagaagccgtaaacccattccaartgagatcactctgaccattggagaatgtccctatatttgtaaggactgatgccagcctccttctgccatctagacattgcctctgatgctctggagctttttccctcctcttggaagcctctgagttcactgcctgccagaccattcattaattcagtcatttatctcttcgttcagtgaatctatgatgctctctctgagccagcacagggaccataaaagctcgctctggggaggcagccaagatgggccagtcacttgccataacctgaggcaggatgtgatgagggctttaagggggacagctgccatgtgctgggggggtcttggggcagggaggggccctctagcctgagccgaagccagttgtcccaggaaggtgacattggactagacctataggaggggagatgccactccaggcaaagggagaaggtgagctgagccaccaaggtgggkaagggtgcagacatgcacacaccaggggtctagtgagactgggacccgggctgggggacaggagcagggggagggaaattcctaagcaaggtggaaggtgagccctaggtcatgaggagattggctggctgaggagtatgggctgcgtcttgtggcgctgaagatttggggcagggagatcaatccaggagctcttggtgaggactacacgtgctgagacaaggaaggggacaggtgaacagacctcgccattaccagaaaaggagaggtgacaggggctctgcctggcagggcggtgggtagaagtgtgagatgctgcgctcaaggagccattcagccattcacccatccagtccttcactcagtcagtcaatatttattttgcgcctaaatccatgccgggctctgttttagcagtgggcccacagtggtgagcaaagccaaacaaaaccttcatgtcctaatgaagctcactttctagtaggtggagataggtggttaagagacgtttaaacataggagatatgtgatgggaagaaaaataaagaggtgctgggcgtggctgctcacgcctgtaatcccagcactttgggaggccgaggtgggcagatcacctgaggtcgggagttcgagaccagcctgaccaacatggagaaaccccatctctactaaaaatataaaattagccgggcctggtggcacatgcctgtaatcccagctactcggcaggctgatgcaggaggatctcttgaacccaggaggtggaggttgcggtgagctgagattgtaccattgcactccagcctgggcaacaagagcgaaactccatctcaaaaaaaaaaaaaaaaaagaaaaagaaagaggcttgagcccagcggtttgtaaccagcctgggcaacatagtgggaccccatttctacaaaaaattaagaaattagccaggcatggtggcaagtgcttatagtctcagctgcttagaagctaaggtgcaacgattgcttgagcccatgacgtcaaggctgcagtgagccatgatcacgtctttgcactccagcctggatgacagagtgagaccctgtctcgaaaaaaagaaaggaagacagatggcaggtgggcagagaaacagttgcagtgggtggtcgtgggcattttcagagagccctctgtgctgtgctctgccttcctggttgtcctgcctcagggacagttcagagaggagagagggagagctgtgsgcccttctctgagctggggagcaggacacaggcatctggctctgacccggactttcctgcttccttgcagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggttgggggacattggagtgggtggctgggagcctctgcttgaaagtggccaagagaggtggtgatgagctgagggctgagagtggccggtggagggtggcaggggccatctggtgtactgcctagggctgtggccagctcacagggtgcccctctgggtagatgctcgtcctcgaggctgagcagcctggctggtggggtgggctggactcagccctcactcacctcacctctgctgggtgccctagtgcagggcgcagtttgccccaccagaagcagtggcyctgggcatgatgggctgggaagttccagggcaggggtccctataaacctggcctgccctggcccctgcaggtcctgggccccaagcctgctctgaaggagggcaaccctgaggaagacctcacagctgacaaggcaaatgcccaggccgcagctctgtataaggtgggccccccaagcctgccctgggacccggcagcagggagggtgggagcctgcacagcacagctgcatgcaagcagggtggaggggagaaggcagggggaaggtggggctggaaccgaggtgggaggtggggagttatacagggctgggagtgagacaaggatggggagtgggcggaaggcaggccctcctgaggagatgagtgcacctcacttccagcctatgcttggtgaaggcttgaagccaatgctgagcttttctttcttgaattctgtgcatttctttgtaatttggaatccwcctaatttccaaatgggttcrgggcccctgtgctgcagggattggggtgatgagagggagtggggctgcctggmatttgcttttcaggtcttcactctcttgtctgctcctgggacctgggcagtgggcagcgaggcacagtgggagggacctagggaggaccagcctccccctcctcaggctgaggtgagggctggtgtgtggggggtgagatcaggcactgtccctcctccccaggtctctgatgccactggacagatgaacctgaccaaggtggctgactccagcccmtttgcccttgaactgctgatatctgatgactgctttgtgctggacaacgggctctgtggcaagatctatatctggaagggtacgtggctcctctgtaacagcctgagatgcctgtagctgctctgacccgggcaggcttccctttgcaggactcagcctgtctagctgcttgtaaaagacagcctcaggaagcctgcatgcttctggctgaccattttctctctttaaaaattttttttaaaagatagagatgggttctttctatgttgcccaggatggtatcaaactctcagcctccagtgatcttcaccttggcctcccaaagtgctgggattacaggcgtgagccatggcataggccttgctattttctttctttctttctttctttctttttgagaaggaatcttgctctgttacccaggctggagtgcagtggcacgatcttggctcactgcaacctctgcctcctgggttcaagcaattctcctgccttagcctcccgagtagctgggagtacaggtgcgtgccaccacacctggctaatttttgtatttttagtagagatggggtttcactaccaggctggtctcgaacttctgacctcaagtgatgcaccggcctcggcctcccaaagtgctgggattacagatgtgagccactgcctcgccattttctctttgctgttcccacctcctaaattctagacaatggctctgaaactacagcaagcctcagaatcaccccacggcctgtttagatggctgggctccacccccatagattctgattcactaggtctggagtggggcagaacatgcatctctaacaaggttatgggttatgtctgtgctgctggttccagggatcacactttgagaaccactgccctagcccagctctagacctttggggcttctgggacccctgatcctgggattctgtctcaaggtttgacagaaatgaattttagacaaattaaacatcattttatgcagtgagtggtgaacctgtagaacttgtttttccaaaagattctatcttctggaaatagaaacactgttgggcagagcctgttctgcttggtttgactgaaaatgaaacaaacttgttctcagtctctgcctggggtctgagaattttcagcaatagcatttgctcaacacccagttgtggggtcaaccaaggtggagaaaatgccagcccctagcctggtcaggaaggcagacaagtaggtgggtatctacagatagctgctaccaggcatttcatagtattgcttctgaaactcagcagggatagaagtgaaagggaggagctgggagcagcaaaagagtggaaagcgagaggcgtgtgctgcagggctgccttttctctcctgccagagggcacatatcccatggaaccaatgccaagcagaggggggttcacagaggcccacagaagcatgtataaaccggagcaaggaacccaacaactatggaaagagaaatcagaggaaaaacaggaaacttgggaggccaggaagagaaggatctcatgggtaggggggcagctggtcagttgacagaggaaggaatccagcatattaatttcagatacattgtagttcatggcattttatagcctgcctagagagccaaccacatcacggcatcgtttcggtatcatttccttggaaaaatgtctggcagcctgggcaacatggcgaaatatcacttctctacaaaaaaaaaaccccccaaaattagctgagtgtggtggcgtgcacctgtggtcccagctacacgagaggctgaggtgggcagattgcttgagcctgggaggttgaggctgtagtgagccgtgttggtgccgctgcactccagcccgggcgacagaacgagactgcgtctcagaaaaaataaaaataaaaaagcctggaatgagcagtttgagttctcaggactgctagcagaaatgactggattacgtggggtcttcatttttgtaagtgcttagttagcataactgttaggccagtgtagccctgctggcattatgggagtaaatcacctctataataaattgtaccctttgtcttatttagtttttcagaaaaggcttgatgaattcaagaggtgaggggtcctagaggaaaaggagacctgcggcctcacagtctgatgctagggtgaacacctgttcccctccctgaaatattccaggggcccaggtcagagcagagttttgcatgatcagacccgggcagacgaggggttttcatctaccttggtgctgccrgtttgggaaaattcttaagggaytgactccacatctccaaagagcccctsggcattcttgggacccctgstccatttattgtaaaaattgctggctcttctgtggactcccttaaatttcctcaagaaaaatgggatggcagctaaagagggtccctgctctttttaaaaatctccttcctatgatctagggcgaaaagcgaatgagaaggagcggcaggcagccctgcaggtggccgagggcttcatctcgcgcatgcagtacgccccgaacactcaggtgaggagatgcgcacaaccacagccctcttcctagggctcttcctgtggcccctgacccctcaaattggccaggaagggcaggagagccttgggcactgtcaggaacaaccaggcctccctcttagacccatccagtgggaaagcccatctcaatccttcaaaatgtcaaaatacttattattttcaaagaggatgttgggcagcactctcctgggtgcccagagaactgggtactcctcctctgggccgttgtccctggctggtgccacccctcctgccgcagcacagtgtccacaagtcatcccgtggggagctgacagggctcagctaccgttggtggcrtttattaaactgtgcacccacgcccttgaagcagtctgttgcctctgtctgtgtccctgaaatcttggttctcatctcatggctcatccaggggagctttcccagcctggactgcacatggattcaggccaggcgcccacaccctcctccctggctctggccccctcctgtcctcctgggcagaggcagaggtggcaactttgtgaaccagacttctcccccgctgtccctgcaggtggagattctgcctcagggccrtgagagtcccatcttcaagcaatttttcaaggactggawatgagggtgggcgtcttcctgccccatgctcccctgccccccaccacctgcctgcttgcttytctggctgcctgrtcagtgcagaggtgccccctgcagatgttcaataaaggagacaagtgctttcccagctcttttcctgcaccacctgccctgggctgattctcactgtcacccacctattcacctgggttcatccccatgctgggggtggagtagcacacagatgacaattggacagccttggaggggccagagctgctttgcatgacagaggagtcccagccaggcttgcagggactgccatgaacccaatagggaggtggcacagtgccaggcctcaggatcagttgcatccgggtgttcagttcagtctcacattcccaacagggagaaggttgtggcaatgggcttgggatgcagttccatttaaggcagtatttcttcggatgccctaataaagcactgccaggcagcttcaagtgacatatgcccactgagcaagagaggacagcctttcacaattgtaccaagcctggcttattacttcgtaggcacattgcccagcatgtttggctggtgagcccagggccactgcagggctgtgcgaaaagcaccaggctagcatggacagtcttcagtctggttcttaccctgcctctgtgatcctaggcaagttactttcctttgctagaccttagttcattctcttgggtaatgaagtggtggtgggatgtcagaggctagagagctaaatagcagggagaatgcagtagccaagaagaggtcccatctgagaaggcatgcccaggggccaagagcagggtgtgagtgagcctgtgtcagcttggaccagaggccgtgaggcctggcaaggctgcaaccaccctgactcatcctcacccccaggtcctctggactatgtggcttctgagctccagaaattggattctttcatcccaaaacaaaaattctgatcaattggcaagttgaacttgctgatttgtgccaagaaccataccatagataccccagccgggtgcggtggttcacgcctataaccccagcactttgggagggcaagacgggcggatcatttgtgatcaggagtttgagaccagtctggccaacatggaaaccctttctctactaaaaatacaaaaaattagccgggcatggttgcgcatgcctgtaatctcagctacttgggaggctgaggcaggagaatcgcttaaacccgggaggtagaggttgcagtgagccgagattgcaccactgcactccagcctgggtgacagagactccgactcaaaaaataaaaataaaaaagaaatgagctcctctgtggatctgcctccatgtcttctccatagacttcttagccctacttgacagcctacacaaagagcaggtgccagggatggttttttaaaggggagagaataaaggttgcactacattagtggttctgacaacctttgtagagacggggagtattttaagtctcctatgaaaggcctagcccctttccctataaatatacacagattaagatttttgtggctgggcacggtggctcatgcctataatcccagcattttgggaggcagaggcaggcggactccttaagctctggggtttgagaccagcctggggaccatggtgaaaccccatctctaccaaaaatacaaaacttagctgggcatggtggcacaaacctgtagtcccagctactcaggaggctgaagtgggaggatggcttgagcccgggaggtggagattgcagtgagccgagatcgcgccactgcactccagcctgggtgacagagtgagatcccatttcaaaaaaaaaaaaagatttttgcatctgctttcagagggttcaggtacccctcacaaccagttcattaacagaactgtaaatttaaaattgccagactacattattgctaatgttccagggtctgaagctgtgagtactctgtcatctggggggcactaaacaggtggatggtgggcagaaaggaccctgcagagggaagaatcacccaacctgatactccaaagtggaggccgagctgcagcttttctcccctgcaattcaactcctgccatgccatgcccagcaatctccctgctatctctgttggttagctgaggaccagactggaggaagtattgtgaatgaaggggttagttcaggtcaggcagacaacacaaggcaaactatggggtttgttaccagccccacccttgaggcatcctgctgacagcagtcaggagttcccctccacgcctgggtggccacctctcttccctacctctgtgatgtttccccctgcagtgggtcagacttaaagaggcctgcagggccagatagtggtcttccatagcattccacttgagggggtccggaggacagaaggtagcatagtggggctctcacctgccccccactccccagctcaggtaccctggcctggaggctcttttttttttttttttttgagacggagtctcgctctgctgcccaggccggagtgcaatggcacagtctcgactcactgcaaactccgcctcccgggttcacaccattttcctgcctcagcctcttgagtagctgggactacaggcatccgccaccacgcccggctaattttttgcattttcagtagagacggggtttcactgtgttagccaggatggtctcgatctcctgacctcgtgatccacccgcctcggcctcccaaagtgctgggattacaggcgtgagccactgcgcccagtctggaggctcttttgggaaggaaccaacagtgctggccttcgccagaagcaaatgcaggaaaaacgtggtgtggatgccttataccagtcaatcttaacaagagctgggctacctcgtccactggctagagcttgcaaggagtctctgggcttgtaagtatagcagaggatggacatcctatgaattcagcaaggtttggctgcagcacaggcaaccttctgtctcctggagcccatgaccaggctggaacccacctatgccttcaccyttaggtgtgcctggctctaaccaggttccggaatgacaggaccacaggatggtgcaagacttgtcttggaaaaaaacacctgagacgcttaattagaacaattcttttatttgaaaactgctggtatgaatttcctccttccctcaattaggccagaaactcatcatggggcatgcacagcatctacaggaggaagccccagcttgtgggggctaggatggagcagccgtgagagacacctagccaaatgtccgtttttccatcataaacaatggagcgggggtcagggggagaagagagtgggtaagtgaatggccagaaactccagagggggcctcacacccacctgtgaggtacctccttgccctacccccactgaggcctcaggccccttgcttgggtcatgctgccccctgtcggctgctgcccctgcctcttcctctgagttctaacaacacagacactggtgcctgaaagccctgctgctgccagggagtcagaattctggctgcctctacttgggaatctcctcccatgtggggatctgcagaacatccagatggggccatcccacctcatgatccattcactcccagtgggatacactggaattcaacccggagactggagcccaacagattaaggcagaattctccttgctctggaggcaggtctgcgggaagggggtgaagtctagctgcccctcatgtcccatgccggtgagggtacttggcttcccacagctaagcccaggagcttcctatatcccatctgctgagacagcaaggggtgcggcctggccaggctcctgacatggctccactgaccccctgaaagcccctgcagctcagcctttaagcctccattcatctcggaggtcagatcagccatacgccttcggatgagtgagactgcaggtcactctcacctgtgaaggtgagatccttgaagggaggggcttctggcccatagcacttctgtgctcccaacaaggaggcctgtccctttgacaccctggccaagtacagctccagggtcttgagcagccgccgtgggctcttcttggccaatacttccaactctgcaacagagagaattggggagcagaaggcttgagggggctctgggtgacacaacagtcaaggcctcaagcctagcagctctagggagtacccccaacccctatcccatggagagaaagtgaaggagcctcagatggagagatcaccagagaggtaggctagggagccagctacagccacagggaccacacactctaccttgtctgcacaattgcaactttgaatagtccaactattggaccctggctcccaatttttgatcagaatatatgcttgtcataagtataagaccagaaaagggcgacagtcagggcagagaaaggagaactagcagactccagggggtgggtgatggagattttggtaagctggaatttgagaaagtgtggatggggaagaactgcagccaaaaccagtctagcaaccaccttgggctctctggacctgggacactgtgcattcagcctaggcctccccagaagaaagagcacacctttgaggacaaagcccgagtctgagatggtcttccgctgtgtcctccagacatgtgcgaggtggaggaatgtggcggcatagaagctgttcaccacggggatgaccttctgctgccgattacactctctgcaggaaaaaggcaaggtgacctgctcagcggtggatgaaggctgagacctaggttccctcccgccttccttccccatttcccsaggggagccagcccaaacccaggatgcccccaccattccccaggagcctgacatctaaggccaggggtgggagaagggatgtcctggggagaccggtgcatggggactttgtccaggccctccaggagccagcaggtggagtagagctggggaaaattaagccagagtggggacgaacaaggctttgctgggtcactctaaccagctggtgtttggggactcacctggagagacactcctctctcaaggcctggatggcaatgtgggtgatgttcacggacatcaaacagaaagggaattgctggaatggaggggcacccagtcagcagcaactccagctctcactgtgtttcctgtcatctgcagcctggtgtggctcgcaggcaagcacagccccagaggcaacagctgatattattattgcttccacttaattttcctaataatcttcttcccatcttacagatgaggaactaaggctcagtgacctttagtaactttcctaaggcatgggaaccaggataccaactgaggttatttgctccagagctgatgtgcataacccccgtgctagctctccagcctcttcatcatcctgacccgtcagctctccttggcctgcagcagacccaacccctgggcccacatcatctcctggtgtcaggatgaagacagaagtgagaggctcggtgctctaactagccctacgggttcttaaagtctcctctccccttctttgggcttctggttgtctggctgatcgtgagcacctcatcctaagacagagaagacgcacgtgggtagaaggtcatcctgacttggggggacaccccatctcacgataacacagaggcctgagagccagctgtgcgggtcagaccccaagaggaggcagcctgagtctggcaggggagcttcaccaggaagggcctcagaatcccctacagggacagctttaatgctctatgtttagtcaggcaagctcctttctttaataacaatgaaaccaagcttgcaaaatccctgaatggaaagggcctttttttcagggaacttgcagacatgacatgttattttcccctgttgcacatacacaaggacacccagtgagaggaacacatagaccagtgcattccttagtacagaacaagaaccaaggtctatttatcccacctgcttcccagttgaagaaaaatccattacattatagtatagaactgtactgcccagtatggtggcaaccagctgcatgtagctatttaaatgagttaaagatgaaaaacaaatataaattcagctccttagtggtactagccacatttccagtgctcagtagtcacgtgtgcttagtggctgctgtactggatggtgcatttccaatatctagaccacttctgtcactgcagaaagttctggacagtgctgaactgcagaaggtcttctggctccacagagatttttctcagggtcttccatgatacctgaattccagatcttggcctggctacctggtagctgtgtgtccttgagaaggtcacccaacctctgtgaaactcagtcttcccatctctcaaaatcaaaaaggacataaactttgagtgctgtgcagaaaaaagttaacacagcaggcctgagactccttagagcctgagccttagaaaattcttagatcaggccatggctgacagctgagaacttggattttgagatggttcccatcattccctaacattgttcctcaactgctcatgcaaacaagatagtttttgctggctgggcccagggctc

SEQ ID NO: 12377 - DNA, 93722 bp, Homo sapiens
aaggaggcttgcatttgcttcttctatgactcaaaaatgaactgcctcataaggcaatgggaattccctgcctggccaaggaaaaggggattgttaagcattctgaaggctttcttccctggtctttcagcttagaatcaatccataggcacgacattcacagaagatagaatttgactcaggagcacagcccaaatcttgaatgtakgttttaacgcttaaactaactttattctaaccttacccccagattactatgattgcatccaatgtccaaaagttatttcagccactaaggttgatttgtgctcaaggcccagtttccaccgttcaccctgttttctcaacccaaaactgcattttctgttgctttaaaaatttgcatattttctcagtgcctgtttctgacttacaataaacaatacccagacctcctgccaaaaaaatgtccaaatgcgaaatagttgctataatagtcgtttctgtgatggcaactttgagctgtgtgcttttaaattataattacttttttccttacaaaagatgtgtatctgtcttgattgctgtaattatgattctataccagcaaacagttataaaagattcatgtcatcactgtgcttcataaaacccatgcccctcaataagcttcctttggtactgtattatgtttgtgtttaatttgtggcagggaaatcctaatgagaagccattaatcactgagtgtatataaaaatttgtgtccttaactaaacagaccaaagtggatatggcaagcccgttattggcatgacatgatttagaatcaggaaagcgatttgagaaaaacaatctagtctaacctagttttacggatgacattcagaactgggaaaggagagcatgtggcttagtgactgcacacataatgggaccaggagcccagagatccaggtttgaaacctgaacttggcactaaggaattatggcacaaactgacttgacttcctcattcatcctcgcttcccaactgtgatgtgtagaatccacacattaaggaggtgcctcacccagggagctacctgggggcaagaaaagggggacactgaggtaggctctgaatcccacccaccccccattcaattagagcagccacacttggatctattttacattgtaatgattgaagaaggaactcattggcttttttttttccttttaagtttgatgtttactgacttcctttctccaagtcttagaattggaaatggactgatgaaccctcttgtgtttgtgactgtgttgcatctgtttattggtgcagcaactcttttctgagcaccttccgttctggttcctaagtatgcagtagttatccatacaggccctgccctcaaagaccctgcagtctagacagggagaattgcagcacaaagtggtaatgactctggagatttaaacccagggggccttgggagcacataggaaaggcaaccaagcccgttggatttggggagtggaaggagattagagttgactccccagaagaaataacagattgtaggccttccttttaatgttctttcctttcttttctatctgtctttaaaaaaactcctgggggcttcttttgggaaaagatgagaaatcaacatgaagaactcttgtcttagcgctgactatgatccccagcatattactcaatccctactgatctccaacatctgggtctacaggaccagtaataatagagtagaatagacctcaaagtattatcacgaagattaaattagataatgtgtgtagaagtacttaaaaaactataaagccctgtaaacatgtctgctgaaggcttcaattccaatcaacctacataatcttttccagctaaacggatattcttggttctacaaagtcttgactcatgttgagcaactggggaaaatgtcacttttcaatataaataataattgataacaataacatgtgtgaagccttcattaaaaagcagaccctctttagctttagaatggagaaaacatgttgttttttaaggcatcattatgtccacctgttggctcacttgtgagaaaaataacagttggtgtaatttcttgccacgtgggaatctatttgggggggttcctcttgctggtcttcacctttgtgttggtgttccctaggcttctgcccttgctcagtcctcttctgaaaccccatcagaggtcaaaacagaagaacttgctagagccacatgctgataactaacttgagtgaagtgagcaggacaagtgggctggagagtgcacactccacctacaggaggcagccttggctcagtgtcagccgaccccttcaagggccttgatattctcaaatggtcagtatttttcagtgtgaatgtgaactcacctagtttgtaaatgctcctcctgccccttgacttcctaacccaagtcttagtcacttcaaggctttgcattttacctaaaacgaaaattacttccctgcttaaatcctgtggctggctccccattgactaggagtggagttcaagttgtaaattcggcccctactggcctgttctccagcaggaaccactactggctccctgccatgccacacgatggctgctatgggcaggcacctgctagaaacagtgtacacaatgtggatccaggcacagccccttcccttaagttgctaccagtctttttgacatactaactggtaaataggcctcagcacacagcgatctcataaccttctgttgggccctgtcctggcccactgcttaataattacgatgcgtttatggactccttgaggaaagaaactggtatttggaacacagtggttgctcaatgtttgttgaaagaataaatgaatgtgataaagttaattttagttcacctctctgtagttggatgtttttaggcttcatatgactataactttaaaataaaacctagttatttaaaaattcaactaaccagacttcaccacaggtttttttgttgttctgctttttacattcatatttaagaagaaaaaaaaatcaagacaaaatggaagacaactaccacaagttcttctacacctactgcctctaacacatccactgttacactctggggttaagtcaggtcctgttcattgtcttagcattctacaatttccaaattctaggaggagaattgacattcatgatgatcctaaaatgcaagctatttaaacaaggaatgattttaaaaccatcattaaattaaaaatcaacttggaaaatattgaaaaaagattaaaaggttttctaatccattttgttgctcaaaaaaaaatccaattaaccaaaatttcctaattttgaatggtgaagtttgactggcctgtaccatgctaagatcagcacgtgcttattaccgtaatctcttgttcttcaaaccaataaatgctccctttaaggacaggttggatttggttatttcttgttatactgacattttttcccaaagaaagaatttacygataacatacttcatcacacaatgttcacagaaagatcttgacagattttttcagcaggaacagcatttgctgctggtgtttgtgtttttttcatttgataatactaacattaatatgatcccccagcttctgtgtctcccaccctgagtagctttaaatgaaatacagcatacagagacttgttcataatttcttgatctttcatttatttagtgtttctagaaggaaaaaaaaaaaaagatgttttaaagctcaagggacttaactataaagtagaggggaaaaggtagaaatacgcgttgaggaaacccaggaggcccccaggcatgacttttgctatagctttccagaaagagaaagtggtgcttaaagaagtaattcccaatgtttccctccagactaaaattggatgaactctgaactgagactctttgcatctcattttctcattaggttttattacagccaacaaaactttcagtggtgaattacttcccttctcaacagaataccagactcccataatgtctacacaaactgaaataatgaaatggtttttaaccaagctttagggattagagaggaaaaaaaaagtgaaaaagaaagggcaccagggtcttcccatctctatgctaaccaaagtgtggttttccagccctttttcttgcctattaacaaaaataaaaacaaaaaatggaaatgccactgggcttgaaaccccatttaaaatcagatttctctttcgagttcccttgcaatacaagtcaaagtcatttccaccaaaaaaaaaaagcggtggggggggggggtgtgcaaattaatcctaaactcatggctcagataggacctggtatagtaaataaatgcttttaaaagtagtcatggcattgagaaatggctccatgcacctaaaccagaggcaccaatgtaaaaactagtaattgtgttttaacacaaaagattgaaaagcgttttgtttcacatcctaatattattccacccacttaaaaagagttacttaatattgactctgtattaggtataagacaagttcttgccctcaaagaacttataatttagttgagaaaccaaaacttaacatgagcttaaaaagaaggatgcagtacaaaacatggtataattaagtgttaaacaatgtagtatagatgctcagtgacctaggagatcagaggaagggaagggtcactgagggctgggaatgtcaaaagcatgtactttcagtaagttcttaaaatgatagcatgttagaaagctgttataattgctgctgatttgtaattttaaagcattgacatgattcaccattgctttccaaccagtagctgtttaaaaggacatacagttgagggtgaaaggagatatttctttatgatctccagagatttgtattgaggggaaaaaagacatactttcttgttgaataatagaccaagaattgagcatattttgcatggggaatattaaattcagtgaacaagaatccaaacctcaggctgtgattctggtataaatttttgtttctaatgaaccattttcttccttctaaagaagatttaagttttgggaataagtcacctcaaaaaaatttttttttattttctaatatctattttcacaatttatttttcttttaagaaaagtggactagaagcgcaagttaccttctcaaggcaatgagaattttttagctctaaaaaagttgtgtgtggtagggagaacatttagcatcctttaaaatggagacatctgaacagcaacctatcttttgaatcaccaaatctcaagtgtactttgcactcttggtcttaaaatgcttttcattttctagtttggcaaaaattccagtctctttacatttgctaccttttccgtctttgcaacacaggcagtgtgagctaaattaggtttgttaaaatgaagttttgaagtttaaactgctgaaatagaggcatgtccctaactttagacaaatttagagaatcgtagtaagcattattttttttctacatacttgtctgcattcagtgtcttcccaagaaacgtcagttaattccccgattcgaaaaaggaactttctcgtaacagttgtacaaccaggctaaagagcacaccctcgtcttccctgaaagggaggaaacatgcaataatgtgaggtaattaaatttagccttagaaaagtctttgaaacgttctaatcaagactttcagctttccgattgtgtgcgctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaaggtaagtgtcacattctgtgttcctgctgggtttaatttctcctttcacttctctgccgatgtattttgccttccaagcagaggagtagcctgaatcaaggctagccattttggtagataaagtccttgttagtcatctcacgtcgtgagagtgtggtgtctgtttatgccgggtccgctgttaattcggagttgagtcattcggggtggattgggggcagattgtggcgcgagatctagaaaaggatcaaggttgagcggatctgcttaaaagtgactggtaagaggaatcagagctattagtttaaaaaaaaaaaaaatctggtctctcctatttcccggtcttcacttctccctaagcatttaatccagtgtgaagtcttaaacaaattagaagtcttagtatcactgaccccaacttgcaattttatttaaaaggcaaactgttaagacaagtctttttttttcctgcactgggattgcgagaagtcatttgcgaggagtcctttggtttccagttacctcccccacaggcgcacacgctggctgcttgcgttggcagcgacacacatccatggtacggctggttttcactcggattgattatgggaagggctatggattagagctcctgtaaagcaccaggaggaatcccttgatttttcagaacagctgatttccaccaggaaagagatttactgaaatgtagttaaatagcgtgagtgctttaaagaaaccagaaaccacaagctgtaatgtttggaatgaaaattggtttcatctcatctgttctagaaatcctaaattttaaaatgctaaaaagtcagcgatagtttcctcggaagattccagcatgtgtgtcacaaagaaaaacactacttcatacttctacttgtgataaacgaagctgaattgtgatttcagatgatttatagatgtgcccagagcactttgyttatttcatggaaaaaaaatgaaaaaattaccctgtaaaatagtcacatgtatttcccatgtactgtgggcacctgtgttctttttatgaccatatttactagtagatattattatatttttttcttaatgaagaaaatagctggttactttactgcatgtaacagagacaactcccacctatcagtatcttaattatttttattgacctggttatgctttcaaccatgtatacagcataatttgtcaagtaatgattgaatactttctgtgcattcagttcaattggacatttactgattgtgtacgttgtgcaaggcatcagctgggttctgcgggggagggtgggaataggggttctcagtcagatctagytctgaagaacccttttatagcctcattggaaggggaaggacggatttttaaaaagaaaatagaatatattccgaatttatgcacatttctcacacgtggtccactaaaatatgcacactgcaaccttgaggtctggtattgtggctctccagtccttgattcctgctgagattatgcaatttgccaagagcttgcctggtgtggagcagcactgatttctcacccctggaggctataactcatgtctctttttctcccattctagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcaygctagatttggccaaaatgtaattatatacaatgtcagttgcacttaaaactaatttatacaattagtacacctaaaatgacatgttggttccaaatagtaattatattctaactggtgctgacttgaagctgagtwtcaacgcttaggcacagagaccgaatattttatgtgtttgcactctctcacccagcaactgggaaaggtagattggggaaaatgttaacacagatctctttcattcattgctttgcagagcctgccataaccagctatacctttttttgaatcatttccatctcttactaatttagcagggttgacagcaatctgtactaataaaatattattgttttgttttgtttattgatcttaaaagttatagtttattacttatgggtggcattgatcctactttaaaatatagctgaaaaaacctacttatttggaatttttgaccaaaccaatacagaaatccttagaytgacaaacatatacgccaatgccaggttgtaaaaatattccaacttaacctaccaatttgccaccaaaaaagaggcattcagtaccgttttaatctctactttggagtttgccaagatttccatcaactttaaagaggtaatgatttaataaagattaagaaaattctgtagtgtgtaaatataacttttttcaagaaaattgaattcttaaattgtagacaaatgaagtatagcaggagagtttgtcacaagattttagatacatcccattttaacatcattgtcttccattagtaatcactggtgattaatgatggttcaattaatttagagatattcaaagagaacatgtcctaactgacccagagaagtaatggctttccacagtaggtttccaggcttgaatatattcctgggtgaaatatttcagtcccacatcattgtcctggaagtcaatgcaaaatacagtctgcttgcctcatttgtcactctgaatcaaagtcattgccaagccaagcaatagctgcataataataattgcaaacatttatatagtactattccagctactctgtaggagttttgtttatattagctcacttaatcctcaaacaagcctatgaagcgagtgagaaggtatgattactatgatcttcctcattttgtagatgaaactgactgtggagagatcaagcaatttgcccaaagtgacaacactagtaaactctagagctggaagtcaaattcagtctagcaccggaggccattctcttaaccactctattcttcctctgctctgctgctagttgacatcttttaagagatgccaggaagagaaataccctcatgagttgatgaaggccagttagctagcagtgcattcacacagcattgtcatttaactgcawgatttacccggttacctcaaaagaaaacttacagttctcctatagaccattaagccacttccttctcattcatttaacacatactcatttataattcatgatcctatacgtataataaatagagctcagtaatactggagtatatttgaaaaagatggagaaacaccattcaaaatggtgttgtaaacaccagaagagtggaatttctaagacagaaatgtttccattcaagaatacaggaatggaaattcataaaacttgaacatggaagacagattgatggagaaggaagttcctaagtcattagtacaaagcaataacatctctaataaaaagaagataatgccaggatttaaaagtctgtttttctctaggagttctgggatcatccctagtctatttttctctaggagttctgggatcattcctcacccagtgagggctttcctaagatttgtgagaattgcaataagagttggctgagctagggtagataagttggccgggtgccctcatggttggctttactaatggaaactgaggaggcagaagcagcaagaagaaggcactaacaaagaaacacataaaaagagctcattgacagtcaaagagaccactgagtctacatcaaagacttggaatagcaaatagacaacttaggagcaaacagatttaggagagaaggaagaacccttcagttatctgttagtgtgtcttccatcaagaacccagtgaatataaaggctctatttagcttgtcactgggttccatgtctaccagtcctaagagataggaaaagaatgtgtctgtacaccaactcttaatttatttgctgtagcataagaaaaaacaagaaagatgctagcaaggaagaaggagataattattttcccccaagatgagagatgagaagagctatagttattacctagttttcaaattcctaggtttttattgcttttagtaaaaaaaaaaaaaaaaaaatcactgggaaaacctatgtactgggttgaatcttttgtttagactgttttttttttttgcctttttgaaataaaatgtatatgatttaatgtgtagaagtggaaactagaaaaatattatgataaagacatgtgaatccatatattcaaaataaagcagaaaattataaatattttgatataaattcatctacaagcataagcatagaaccatttgtacaattttatgtcatttctactgtcatttctaagcaatgtcaaagtctgaatgtgccatgccatgacaaaagctcatgtaacaagagcggttagcaatccgagagaacacagtgccaagctccacatcccttagagggcccgtcatgaaagcattagataatggtctgccagggctgttgtggacatccgtctgacaaaaaccacactgggaagagtggttattgtctttcttcctccagaaagaaatttctccctttggactgtggtaagttgtgttagagtgacctcagacatctagctgaaagaaaggaaaagtcctttgtcatgttcaagtcacagaacactgactctttccatggctagggaatgaattgcacaataaaaatgaaatctcaggccaaacaatataaagaaatgggtcataagatcagctgcaaggttgggggatatgtataaataggaatgcatagaattgagtggtagttttacctgaaggcattcacaaacacagtaaactagcagctttctctgatgttggtcttggcgcacgcgcacacacacacacacgcacacacacacacacagagtttgcatttgagttctcctttttctgatggtctccttgcacagttcacatttgagttctcctttctctgatattgatctctcacacacacacacatacacacacactcacagagtttacatttgagttctcctttatatggatttgaaagaaatcggtgaatcatcctggctaaatttttataaagcatttccctctgttctctaatactctggcaatgaatttaaattgcactaaaattcagtggagggaggatcacttgagccaggagttcaagatcaatctgggtaacatagtaagttctcatctctccaaaaacattttttaaaaaagtatccgggtgtagtggtacatgtctgtagtcccagctacttgggggggctgaagtgggaggaggatcacttaagcccaggaggttgaggctgcagtgagccatgttcatgccattgcactccagcctggatgacagagcgagaccctgtctccaaataagaaaaaaawaataataataataataataataatggtaatagctaacactcacaatgtatggaaagcactattgtgtttaagtgtattaactttatttaattctcacaacaacccagagagggaggtaattttattactctcattgtacagatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctgaggtagcaacggaagagatggaaaagagaggtcgaactgaaagcccrctggtgagacttggcaattgattcaatgagagaaggtggactgcagaccaatggcccgctttctggtttaggtggcagagtggctgatgatgccacatttgaaggtaggatacaggagaaagactggggccttgggggtgcacgaggrtaagttcagtttggacctgttgagtttgtrgggcgggatgccaccgaggtgcatatacaatggaagaagcttgctgcaaatcaagatttagaaggtattcctacaacctccaaactgaacgaagacagttctgtctttggatttcaagtgaataaggatcagtgaatcgggctatcctactgcataaatgagtctactctgtaagtgagtctattctcagaacagtttccgtaactctagggccctctccttcatgcttaaaagcactaatctttcagaaatgctgtagtggtgttctgtgcctggacgtaactgaccaagccagttaggtcagccaagcaggttaatcaatgtggtttgctatcagctgctggactgaactgacctggtagtgggaccacaatagccaactgcttgagttcgtggagcaggcacagtcgggcgcccacacctctcaacttcctgaacccctgatagcggggcattttcacactgattgaacaacagcaatccaaacaacgatggacagataactgggttcagacttacggtttcttcaacacttcttggaaatgagcagggagagaggagcttcaagaagctgggggtagggggatcctgagtcccctggtgttaccagagctcagctgtgctttcactcagcagaggctgggagaggaggaggaggaagctatggatttgcagagtttttctctggagaagccacactgggttaggttataagaactagggtctgatttctctgtgctttatcttctcccctgggggaaaaaaaatacagaaaaattgtcagggctagtgataacacatgtacccacagcacacatgcctcccagccctctcccaccttctccaaaagcactccaggcgctgcctcctactgtgacggtgtagcccagtaaggtatagtggagatcagagctatgtgctctggagtcagacagcctaggtttatgtccagttctggaactgagcctctgtttcttcatgtataaaacagaataattataaaaactgtctgccaagatttatatcccagttctgctatgcacaagccatatcaccttaaatgatttccctaagtgcttgccaggtaaagtgtccatagacattgtaaaccccacatcttttatttacatctctgatatggcttcaagctgtcatatgcactgatttgatgatgctgatcttccagagagctataagaccctggcatttggggaggctggggggcagaagatactcacctggttttggtttagaagtggcttctatttccttagctagagaagagagccaagagagttgtaggaagagccttaatagttgtaacgggcttttagatgcagaaatgaaagcctcagagtaagtgataccatcattatctgtcccttaccgatctggcctcctgagcagaaccagaaagtaatccccaggcagccgttatcacagcagactacttagtggagggggcgcctgacagtagacgcctctctcaggaaaacagggaggtgctaagaaatgttttagtaagtgttgtaatacactcaatagtgaattttttgttcatacctctcagggccaatctgagtgttcaccacctccctggtttcttctttcctccagccctttggtgcctactgcccattaactgccactctggtcagagtgggggctggctggaaccctgagagaaatgtggctggtttccaagagagttgggaaaggttgttttgaagcagtgggtagaagtcttaatgttgttctaagtgtatctctggattctattttgctctttttcttcttgtcatttcagatattgaggaaacagagcaggcaatttcaaatttctctttcaagtaggtaatcaaataagcaagtgtgttcagaacaattaaccttcagtaataatacctttcatttttgtggtggtacagtttacaaagcactttctgttgcactctctgtagcacgtaagctatgaccaggccaccctccttctgatttgtatctgcaaatgtctgggacgcagctaagaaagcattgagagtctaaagatcctgggtacaggcccggctccatcaactaactcgatttttatggtgtaagacaaatctctgggtctcattttctcatcagcaaagtaagtttggactaatgtctgcttccaactccaaaattctatcattttaagtctagtttatcttcctctaaaatatctgaatatatagaataataaacagaggtgttttgctttgttttattttgttttgctttgttttgtttccagggcatgacactgtaccattgctagaatctttttcctagataacccattctggctggtctctccagtctaacaaatagcccccttctctccctttgacctcttgagggcccctggctctgggtctgataatcagtgtttcctagccagtgtttgagaacacagtgaggacacactttgcagaagccccttctgcccttcagtctctgcccatctctcataaattaggggaagaaaaccacaggcttttgtttttgctatggaataaataagattgtgaagagcctaacctgtttagaggaggcaaccagagtttgagcactgtcttttccaagctgtacattccaggtacttgatatttatggaacactaggatactatcattcatcaagtatttgctggcagctaggtgagctgcatcattgctgggagctgagaaaacacacagagcacttcagtgcacagagtttagcgactatactcactgagtataaaaatgatgaattttgtctgcgtgcagtggctcacgcctgtaatcccagcactttgggaggccgaggcgggtggattactacgtcaggagttcaagaccagcctggccaagatggtgaaacccggtctctactaaaaatacaaaaattagccaggcgcggtggcggctgcctgtaatcccagctactcgggaggctgaggcagagaattgcttgaaccgggaaggaggaggttgcagtgaactgagatcgtgccactgcactccagcctaggtgacagatagagactccatctaaaaaaaaaagatgagttttatgtcaagcttcagtgctatcaagattgcctagagcttattccctaggccaagaatattcacatcactatgccctatcaagagatatgctcaagagagtttgaaaccaaaaagagaaagataaaaggcccaaaaaggtttagataaaggaagatataccctggataagttaagggagggcgctccctttttccctttgtataacttatcaaagattggcrggtaaatttaggcgcagcaaattgaaaggcacaaccaaggtttgaatttcaagacggggtttctgtctccagagagggcaactccattcttcttgtcctcagacttctccagttctccaacaatgtttccaggctacaaactgctgctgcttcacacagagaagacagccggctgttagcgagagacttcttattcagaaccttgtatgatgaggctcgtttatccctaatgagagtagggagaaaaatataccctgcaaagatggtcccttcttttatacacatcgcattacttgaaatatcatctttcaagcaaataaaacaaaagcccgggtttcttgtgcttgtctagaagcttgctggtatcttcagctacttgatgaatgtgaagagaaacatcaagaaggaaattatgagtctatggagaaactccctgtgaaaaaagtagtcatgcttttatttagttatttatttatttttgttttcttagatttgcccttttagggcaaatgaagtagtttgtaagcaaacctgagattcaacaaacttttcagggccttgtaagttctgactttgcagtgctttccacgagacgatgggtgacgaggagcttgtcatctttgcagagcggtttcagttttctcatacttgtaactccaagggctaattgattgaagttgcacatgagcctataatgattgagttcaaagttttttcagattcgcttccttgtctccaaaaaaaaagaaagcggtttggtcagaaagtgatctactcactataaatctgaacacaattagtgactttcctctccatggcctaaactaagtaaactcctcgttaaagcaaattaaagcaggattgaggagaaatcaacccagactcaaagcgacattttagaaagatgcaggcatccagcaaaaatattgcagaaaagaatccaataagattaaaaaagaaagagggagaaaaggttgcgggcttttttttttttttttttttttggcctattttattttacttatgtagtaaataaattaacatagtccaaaataaaaaaatagaaaagcttataaaaagaaagtatctyattgacccctgtcccccaaggttcccgtttatcttgttattcatttctcgtatgcctttggagaaatgttatgactataaaaataaatatgtatttattccttttttgactctttgtatacaaataatagcatagtatacatagcccacttttcaccttgcttttttcactttacaatatacctgggatattattccttagcacgtagaaaggcccctcattcttagggctacattgtatgggcataatataacttatttaagcaattaccaattgatggacacttcggttgtttccagtctttagacatttttatttaaaaacgttgtaatgaatgatctttcacccatgtatctggatatacctagaagtgaaattgctgggtctaaaggtatactcattcataatgttgataagtattgctaatttgtacyccatagaatttgtagtcatttgctacaaatgtgggatttaaaaaagagttagcctcggtactgtactgcctctgccaaaggtaagcatgagtggactttgcagtttgtgcgggttccgcagacagactgaggaaactaaggaaatcagtgcattggaaaactgcaatttcaggatagaatcaggtagatgcaggtatctccctgcttctaaagcccaaatttaatccatatacaacacccaaagctttaatttgtatgttacattcaacttttgaagccctttcacatctcttaccatctatcatcttcacaataaactgtgaaagagatgaaccagggtttcrgtttttatccctccctctaagccttcaccccctaccaccaatttagcagaagtttagaaagtgaaacattgagtgatgtgtcaaaggcgcttagaaataagagactgccagaaataagtctatagaagctaggatcaccccgctcccaggccagccctggctgctttagttacagtcttaggggatgcaacctgtccacaaataattccccagaatactggtgctaacagtctgagcacagatgggtctcggctgggctctagagcagaacataaaatcaggaaactagagcaaactttactcttcatactgcacagagacatatcagttagtagaacagaggctctgaaagaacagaaaagggaatagatggaaatgggaacacctttgctgtgcaccagcatataacacacaaaaggcaccaggggaacttgggaaattttaaacatatttcattcccagtttctacttgttcataataatttcctttttccagaaaggaaggcaacaagtcctgcttttaattgctatttctggaatagaagatttttaaaaataacaatggattggacatttagaatacctgtaggattatttgtaaattaaattaccacttcacatagccttttttggtgcagtttttggaagaaagcaccaggcctttcttaaaactccaaggttcttctgatgcagttgtctctaagagtcacacaccgtgtgcacataagtccgtgtctccactctacttggtcatcagtcacccagggctctctcatttgggcacccctggtggaacaaggctggggcaggtatttcccaccttcaacaggaaataccaaaggacaaaagaatgagccaggccaaggcccaaatctcccaaggatgtggaaacagaggagtgggggagggttaagaggttgcctccaacactgagtagcttctcaccaggaaacgcctgaaagtttgacagaaacaaaagaccagggaccagcagaactcttacccaggtagattcaccattatggctttgctttctttgtaaaaataagccaatacagcctggcacagtgactcactgctgtaataccagcaactcagggggttaaggcaggaggatcccttgagaccaggagtttgagaccagcctgggcaacatagtgagaccctgtctctaaaaaaatttctaaaattagccaggcgttgtggtgcgcacctgtagtccttgctactcagaaggctgaggcgggaggatcacttgaggccagaagttcgagaccagcctgggcaacagagtaagaccctagctctaaaaataatgaaaataagcraatggaaatttatgtccaacagcttcatcaaactgtagtttgtaagcaaacataaaaatcataagtgtgagacaggcttatgatttctccaaattgggccaattcctgaaatagaaatttttatttgatttctcatataattattgcatgcctgccataataattgtaatggctaaattgctaaaayattttttgactcattaaatgctctcatatgcattatcaaggagtttagaattcattaacagaaacaagatgaattagtataaagcagctaagatttataatgcttttgatgaacatggttcttttaaactcagaacttaaagttcaggaggatcttagacaccacccattccaattgatctctctcattttgcagatttttttaaaaaagaaaaaagaggcctgaagagattgtgtgatttgaagatatggaaacaggcagacctaagtttgccatcccatcctctcatatcacttaccgcaatgtgccttgggcaagtggcttattctttctaggcctcaatcttttcattaatgagatactgatattaaacgctacaggtttgatgtgaaaattaaatcatttagataaagcatcgcctaccctaagttactgacaggatcaggcccagaactgtctttctacarcatcacacttgctctcccttctactcaaaaaaacctaccttaggagcaaattcgggatccatagctgtcattcctcatttgtgaatttagaaagctaagcctatgagaaatcataattcagtcaagatccagtcccacagaccatgagagcaaaatcacatggttttgtacagaggggacattccttagggtaggctactatgttcagggattgcagtagggaatcagatttactggggagcacagaacagagagattcctgcattcagaaagtgtgctcagcaccagctggggcccaggcactgttggatcctgctcatctgaaagaaaataagacatgtttgttcattcgttcaacaatatattaagcacctactgtgtgccaggaactgtttgaggggcttgatataggtcagtgaacaaaactgtccaaaaaaaccaaaaaaagttctaaccttgtggagcttacatttagcaggcagagaaaataataaacaacaagcataataaatagaaaattatattgtattttggaaggtgataggaactattaaaacaaataaaaccagctaagggataggaaagttcaaggtagacctcattcagaaagtgacatttgagctaggtctttttttttttttaggcagggtctctctctgtcacctaggctggagtgcagtggtgcaatctcggctcactacaacctccacctcccaggttcaagcgattctcctgcctcagcctcctgagtagctgggacaayaggygtgcaccaccacacctggctaatttttgtatttttagtagagagggggtttcaccatcttggcctggcaggtctccaactcctgacctcaggtgatccacccacctcggcctcccaaagtgctggagttacaggcgtgagccaccacgcctggccgaactaaatcttaaaggaggtaagtgttgtggatatgtgggaatgatgttttaggcagaaggaagagccagtgcaaggaccataaagggggatcctgtctaagatgatggagaaatgacaaggagggaagtgtggaaacaggtgagagggagcagagtaggagatgggttctgaggcaaggtggatctagggggrcttgccaggagcacccattgattgcatggtcttgggctttgactacatgagaggaggagtcagtggagggagtaggggagagagatcctgacctaggtctcagtgttcttttgggaataggctggagagaggtgaagtagaggcagagaaaccagttagaagactactgcaatagtccagccaataaggagggtgactttttaatcttggagccttcttcatttacaaattagaaaaaaaatttgaagcatagaaggcaatagagttatccaggatcacacggggagttaagggctaggactagaatctcgacatcattaattccttaaacatttgtagagcatcttctctatgaagatagaagcagcctggtaaggaggcccagagacctctgcatgttagattgacctctaactgccgtgtatagctcaattgtcaagtgtgggtgggacttgtgacttctaaccaacagaatatggcagaggtgatgggatgacactcctgtgattatattacaattatacggcaaattcttgtaaccttgagacaaattagtgctagtttggttttggttttgctacctaaatggaaatatcctaactgtgaaatggcagcatttgtgtcacgtaaaaccagtgagtggtgtgctatcaacactgtgattttccttgagccacgaaaatggacatcctggtcccctttctggctagatatgcaggctgaggtttttctgggcaatgggtatgaatgcctcctggcattcctgtagcactaatgctcaaacagctggctggctcatcttggtcaggcacttagttttctcgtggttggcctcagaatgcgaggtctttctgtcaagatcattgtctctattgctttgagatttccttttgacatctgagctcctttggggcactacctcgttttctggaagatttggcgtagtaataactcttagaagactttggtctgccaaattgttcatgacaaagttcgcagatagaggaggtactttagtaaaattttactatttcaaactccaacatttaccaaaagttaagtagtatgatttggtctgaagtttacttcaaatcatgcctcattcttttactcttaaatattttctggcatcttaatattttcaatagttttatcatattaaatgtggaccaaattcttaaagttggtctttagcttgtaacttattgtgtgtgtttggccttaaagagtaaacctatgatatcttctttctgaggctccagtgtgcacgttgtgtcttagtttagaaaatgagacgatatttaattttccaaagaagtatttgttgttggccgggcgcattggctcacgcctgtaatcccaacactttgggaggccgaggtgggcagatcacgaggtcaggagatcgagaccatcttgtctaacactgtgaaaccccgtcactaaaaaaaaatacaaaaaaattagccgggtgtggtggcaggcgcatgtagtcccagctactcgggaggctgaggcaggagaatggcttgaacctgggaggcggagcttgcagtgagccgagatcgcaccactgcactgcagcctgggctacagagggagactccatcatctcaaaaaaaaaaaaaaaaaaaaagaagtgtttgttgttaggaaaacaaggaacctctgaaggactcctttcttgaactttctgcattagcaaagagaaactatttaagcaaaaatgcaactttgtttatagcattcatccagcacagttattttgatcactttaaacattctagtcaatatattttctagattctagaaatcttgttaaaatactaacactggagtaaaacagaaatcttaactaatattgataaccaagggtgcatgatctgaatattgctcatgacatccatatattgtataacatcacctagatgcaaactttgcaaaatttgtttcagctctaacaaattctgctaggaagttattttgattttcattgctatttttgcagagtaatctataataaaggattcgttcttttgcactgaggatctggtggccataaagctttttgtcagctttgggactatcaatcaatgtgtttcaaataagtgaccactaatgaagctcagttttgcaaagggtgagctgctttaccacagagaaagactggttgtggccgggagaggtggttcaygcctgtaatcccaaaactttgggaggctgaggtgggtggatcacraggtcagaagattgagactaccgtgaccaacaatgtgaaataccgtctctactaaaaatacaaaaaaaaaaaaaaattagccatgcatggtggcgcatgcctgtaatcccagctacttgtgaggctgaggcaggagaatcgcttgaacccagaggcagaggttgcagtgagccgagattgcgccactgcactccagcctgggcgacagagcaagacaccgtctcaaaaaaaaaaaaaaaagaaaagaaaaagaaagactggtcatgctacgtctccttggtcggaaagacagagcaaagagggctctgagaagtctgtgtatcaggctgtgtttccatgaaggcttttttcattgctgggstagaatgtaataggaaactagaactgcctaccaagataagcagccttcgtattcaccgcatttcctcttgatttgatgctgatagctggccgaccctacctctggcttcagctctaacgtggcttgtaggagcagaaagctgatgaaaaatgacttttgttgattcattcagcagtgagttgagaaaagctagctgttgacttcgttaagtaaaatcaacaaaacttttcctcagcttaagctctagatttagttaatgtcattcaaaatagatgaraaagtaggcaaaatattgtgtacccatttagactccttcagtcagtaccatggctgttgagaggctgcgaggacagtagagtgggtgagtctggaccctggagctggacagtgtgggtatcaggtccacctcagccactccatggacttaggtgagcacgtaacccctctttaagcctactgtggcgccagcctgccagctgtgtggttttggcaatttaccygccctctcaatgactctgattcctcatctgtgagatgtggataacaataatagtcctggcctcgatacaatgcgtgaggcaatgtgcttgtgaggacttggtatctgccacgtggtcaatgactaggagctgttgctgttaaggatgcaaacgttgacacacgtcttcattaaattcttaattaaatgtccttctcacgttactaccgatggtttctagtgactgaaaatgtgtgcagtggagggaaaggcagactattttaattaataagctttatataagttttattaaatcatgaaaaaggatttggtatagccatttttgaaagtggctataccacctttgagatcttcagcaagtaagaagacctgtaaagggttccaagatgtgctggtgcttacaggacatgtgtaggagatccaaggttatttctccagggcgttcaccatgtaggagttcaagatgctaaagacccaggaaccaggctcttttgagacctatactcaggcctaggctacaagagcatgtttgtgtttgagaggcattaaaagagtaacggaaagagcactgggctttgtgtagaatccctccactcaaccacttatgagatctataagcctgagcaagttaactgacttctgagcatcagtttattaatatttaaaatagacacaaggcctggtacagtggctcacgcctgtaatcctagcacttcgggaagccgaggcaggcggatcacgtgaygtcaggagtttgagaccagcctggccaacatggcagaaccccatctctactaaaaatacaaaaattagctgggcctgttggttcatgyctgtaatcacagctactcaggaggctgaggcatgagaattgcttgaaccaggaggcggaggttgcagtgagccgagattgtgccactgcactccagcttgggtgacggagtaagactctatctcaaaaaaataaaaagaaaataaaatagatacaataatatctacctcataaagttgtgatgagtgttaaacaccatcgttaacacatagtaagggctcaataaattttcccctttcccagtgtaatctcatctttttcaagagtagaaatagctcacctggtaaacccagaaatagtaaaccaaccaaagcatagtcagggataaaaatgattcaaaatgtgtctgaatctactatcactctaaacaacacctctcttcaaaacttttgacctaaaactatcccttataaataaatgatgtctcctctctatagagaagagatgtcctactttagagaaatgaygtcctcctactatagagaagaacttttagacaatgtaggtgttgtcttaaggaatgtaaagaaatagagacacatcctagagtaggactgcacttcccagcaagaccagcttgctgactataaggagagacacacacaaaatatcaccacctcttgagactttgcttcccttactgtcttgcattgttctgttagatatctgtttggcaggtaagagactgtgtcattcacacattacccagaattcattcatggagctggcttactttccctcctaatacctaaataaaaattggttgcactgagtaagtgcagggcttgagtggggaagaggagagaaggtagtagaacacccaaggagaggaagaggctgtatacacaaccagtgttgttgtatcaatgggagtagagttagtgtaggctcagatgagactctggaagatgagatcaagtgcacctagtatttagaataatcgcttccttcatcagcccttgtttgacttttgcttctagaacctatatcattagcagaacagctattctatcaattacttataaataagataaattttatggactagatagtatcctgcctacccttggaaatattactgtatgtaagtaagtgtatttctaataacaaacagccaacttggatatgaatttgtaaaaccaagtctggtcttcaactgttgtttgcagaatatctaaaactcgtgacagcttgatacgttcaaattccagatgaccaaaatgagccccttgtgtttatcatgcacatgttttgttataattgaatgtcaagtgtttaaatccatttaaatgaagatcagaaagacacatcatcaattccagtaaaattaatttgattggaagtaaagcaaaatgtttgtttatttatatgtgataaagcacttatctttgtgtgacttggcttttatgtgagcaagcaggaaaaagacagatataaccaaagtattttattaattcctataagttatggatactgctgtgttaaataatgcacattgtaaatcagaattaaatgccttacaccagattgggttccaggaagattgaaagttaaatattttaaaacaaaacaagtaaacaaagaaagaaacatgaatttaagatctatcaaacttgtgaggggggagggaaattaaaatgtataaactcaagaagaaatcacctaataaaaaaggtgtgcagacattgttataaaaatgcaaaacacctgtacatgtttaatataatgtaaggcaaacaaaccagaaaaacagttatagcaagtattttatacataggcaaagggtaattatctttattatataaaaataatctacccaacatatacacacacacacacgtacgtacctagactcttaaacgattaggattgaatagatgcttggagaaaatacaattaggaaaaatagtcaacatcattagatgttaagtaaatacaaaataaaacaaagtatataatatttactcatcacattatcaaattttgcttgttttaacaatctttttatgataatactctgctcctgggggtagaggaaataaagcctcattcactaatagagcattaagctacccagccaacccacgcagaaagcaatttcgtaacatggattcaggtagtcgtatcctctgaggtagcagttccctttctctaaaactacactaaaaaaaaaaaatcccagatgtaaaatagccttcatatattcatcatgatatgcttcataaaagtgaaaaatgccaaacaacctaaatgttcaacaatagagtgaggacaaagtaaagcctgatacagtgaacgaatctgatatcaggagacctaaaagtgaygtttatggkgaccgtatatggaaaagtatattctgtatgatttccatgtgtttaactatgtattggaacattctgcaaaagagacacacaaagtggttgcctttgctctacaggagaagaggaaacacataaaggggttaagaacctgggatctgagtccaaattgtctgtttttaaatcctagctctgccacttgagtatatttgactttaagcaagttttaagttcatcgtgattaggtttctccctcagtaagttagtggtaaaatagtaccctcctcctggggttgttgcaaggattaaatttgctgctaacctaggcaacacccagcatatagcaagagctcagtaagcattagttatttactatttatttcagtgatacaamcaatatgggcaggattttgccccacctttctgcgttttccaattcaacttttctccttgaccatattactgttacattggaaaaaagcaataaatatttacctgaaggccctgagagctgggtcagctggattttttttagccacgtagattaagattcttattagaatatcacagtttagagacaaagaatggatactttatggttgctaagacccaagaattgaaattggagttgcagtgacaattcaaatgaactttgtgtcccatttcataagaagttaagacagttcagtttccgtaaaagactgcttgcctcctctagaaaagcttgtgccaacccggtatcattcccgcttctccccaccaacccaccacccccagcctttagctcctagttaactcagtgctgggcatgctgctttctctataacttacatggactttttwaaaaaatggaatcacatgtttcagtaataatagcaaggcaaaaactttaaaaacatttacaacactggcataagtaaattttctttggcaaggaaagtaaattaggtaaaggggagagggagtaaatttacacttttattgacaccaatacctttattaatttctgaacatttcagtagttatcatgcataatttgatttaaatgcaaatttctcattctaaaaagattttaaagtttcagttgtagagggaaaattaaggggaaaattgcgttctctttcccctatattctcccacgttttcagggaaaattttggggagaaaatctctgctcattttggagtcttctcttgccagcaactaacaagtctgtacaatacagttaccaaggcaatgtcaagaccatgtagacagagggagaaaatgtggtgtgaagacagggagatgatgaaaatggattaacaatgtgaacatgaggggtttttctaactggaaaaaaaaataaaatcacactatcctttaaaagtggttatgttagcaattctaacatctgttgttataaaggaacttaattaaaataaagccttttttttctatatcacctgttcgtgaatgcttatttgtttcctaattatgccccaatctttgtaactctgtattragccaggtcagaatgagttccactgcattcaagttagacaaagggatttttttacttgttgaaactagaaagagtttttttctataagttctattgaaccacggattcagccagaccctcacagataatgactgcaaagatagatacatctcttgctcccaaagcagcacagatatttgctgcttaaataaatacaaccaccagccaaatacttactcattttgctagggctgttccttctgtttcaaaaaagactcaatttttctttttctttttttttttttttccttcaggtacaatccttggatttaccctccgaccatacagaatgagctaccgggaagtcaagtacttctcctttcctggggaacttctgatgaggatgttacagatgctggtcttaccacttatcatctccagtcttgtcacaggtaccataagcagttgttggtttgtttggttttttttaagtgtgtttattgcaaaagattgcttagaaaagccagtgctttaggtttctgctggatgcatgctctgttctagaaaaaaaaaaaaagtcccttcaaaatgatggaaaggaggctttagtaatgcatgaatgattataactctcgtattttaccaatcacaagaggaaacgaatttaaacagccacgtaatctggttcgcctcacagtgaacgaggtgccctgctaaacaccacaccatcagccttctctgaccacagtgatgtagttgacaacagcgtacaacaggtctgttttctcaccctcttatcccacccagataacatctggttggacagcctattagctattgatgcaagaatgcttgttctcagaaccaccaggacttgagcgggagccttcttggaagcctcatcaagaggtaatgcccacaacactcaccaactctgctgccaccaacacttatcttttcctggtgtacccgcatgatttcatttccttctccagttgcctcccacccycgttaccttttatgctrgtgggagaagggggagggggcgggagattttcccatctgaatattttatcagtggacacttggatttttaacaagtggaagctttgcaggataggattctatgttctatgacaatgagataaccatttattcctgcatgggaaaaggtgaaagagtcatttgtctatgtgattggtgaatcagatggagccaagaagttgcagaaaaatgttactgtacattccttcctgcccactcttctctttccccacagcacatctctgacttggagaaggaatttccatagacactgcccgagcaggatgatttctgggtttgtaggtaaagctcagaactcaggtattactgaccctattctcttttccacccttggctcactgttcccctgttgggcatataccactctacctctatgtgagctggcactgagaatccttcccatcccagggagttctcaaggatatttatactatccttcaagatctctgtgtaatgagaacttcatagtacaactcaaaagtcatggaggaacattctattacatgccttggagggctggctattacttagacaggaactatgtcagattttccctcaatgccttgcagatctctgctggtttccacttgtccagggccttaaacaagtgattgcatgtacatatgctttcactggagaatgaattgcccataaaacagtcctggagttgatttgatgtacttgtttgtgaagctgggatggtccattgctgaccaggggtaatcacagcagctacagttcttaccacaaaagctatattcatgctgacatgagggcacatgcttattttattatccatatgctgatatttttctgggaaacaaattattcacagaaagcacttgtaagacagaacccacatctgacattttctgtggtagagcagagtctctcctcaccatccctgctggcagggcatctggattaagtgcctgcagttttcctatacacaaaccgaggggttctggatcttttatactttctcttcaagggtggaaccaatgtttagaggtatctgctttctcttaactgtgctgaaaatccaatgtgttactctttaaaagagaaaagcccttatatgatacaattagagaagtgttacttccccttagcagcagtcccagttgatcaccaccttgaagtggaatttcctgatttttcttaatacctaataacaaacaactttatygaagaaataagaactttggttgtgtaatttttcagaaaaaaaaatactatgatgcaatccctttgcatggctaaagagaaatttttggtcaaaacttggaaaaattgttaacatttataatattgttaaagagaaaagaattataagctgcaaacaactaayataaaatgaacttttaaaactgtaacctaattgcaagttgggagtgttgccaaattggaccattaagagagttttagctyttgtccaggactgtgctaaggcaaggagtctgaggggcagaatttagttcgccaaagatctttttaaggtgttagtctgaagtgagtaatttccaaactacacagtaatttagatatttatgatcaaatggaatgaatgatggattcagtaagaatgtcctttatggttttgaatacaataattctaacccaaatgagggtatgacccagctataatgggaagggaggaacttctacaaattacacagacccctggaggatccctgtgtatactgggaaatgttactggagaatgtgttgcctagggaagaaacaaaggcaggctccattgctttagagtggaaaggcaacctcaaatgcctccagtggccacgtgggtgatgcatgtacatgaagctgccctttcaggctattttttgttttcctattttgatagagtcatggatacagagaaatatttctcttcaacaagagaactaagagggacaagtatgatgataaacggagagggacccaactacagaataatatggcaaaaggcaggcaaagagactattgagacaagggccagatcttcctgtttttcaagagtatccagaaatctcaaattttttaagaacctgcagattctttgatacaattcacgaaacaaaccagtgcaaagcaaacrcagtacacccattccaatgtaattccaatggcaggcccattccaaccctcagactaccaatatttgaactcmggtttgaatgtcagaatccaatcattggcagtcctgtgccaaagcttaactgataatgtggaattcactactgaacatcatgtttactgctgactaaacaaattgctattggaaagcctcttctctccatcttctsggtataactgcattgtgtagtagccattctggtcttttctgcaccagaaggaacactggagtaagaactcagaggtcatgctcccataggaaatatttcccagtggggaaatactttatagacttgtttctcctaagttcagttgtcccagggtctgtagacagaaactgaaatgcataaaactattattgtgtttcttggactaagctttttattgtggaagattctagaaaacatgctataagtttaattgtactaaagccacatttaaattctgagacatctaagttatattttttacttgaaacatccgtgtttatgagttgtggctctatagcccttgtaagccatgttcccttttccctgaatttgaaactccaatctttccaaacatccctggtgtgtattagcattccagaggctgccagaaagaagctgggaggaagcctaatggctagatttgtactcaagtacctattttttggacaagaagactatgtctgtgccaacacaccacacaataaaataggggtttggtgccagtttctatcgatttggtcaggatgggcagccaaactagaaatttcatgccagaaatatgagttggtttggctgacttagcctgattaaattcactggataataattaaatgtcacatctggttgtgcagggtagacataactattacctcctcacttctgaatcttttcagaaactagtgctttcttcttttctcattctaagtgtgcattccccctcaatcacttacctcagaagaaatctttggtgtcaccccagttttctggaagtggggagcacaacttttgacatgcaatctctgtggtgttgggcatgatgtaagtaaaagaggtgagagaggagtgtcaacacgagtaaaagcaacagtgtctgggacgtatggtagggcaccctcgaggcaggattatcaagtagatgaaatttctcatttaacattcattcattctttaacagctgtttattgcgcttctactatgtcagacactggggatacatgaacacaaagatacagtccccaagaagatgtatgttgggtgctgaggagagagcttccctgcatcccttaattcacataatattccagttccaactaaaaggagataagactcgttctctgtactcccaacaagaaagtgacaagctgatttttaagaacatgatttcaaatctgattttcatgacacagcatctccatcctaaagtcaactagcccagaattttccatcataggtaccatctcagtctcatttacttaatattttctttaaaccaacatactcttcttccacagcctacaatcattacccaaaatggaaacctcctattacttgtcatgtgaaggagataagtaacaatgttatgaaattgtaaattgatgcaattgcctaacaaaggctctgggagcctgagacccgactcccccgctcttgtagtatttttaaatggctgggcgtcgtggctcatgcctgtaatcccagcactttgggagactaaagctggcagatcacttgaggtcacatgttcgagaccagcctggccaacatggtgaaaccccatctctactaaaaatacaaaaattagccaggagtggtggcrtgtgcctgtaatcccagctactcgggagtctgaggcaggagaatcacttgaacccaggaggctgaggttacagtgagccaagatygcgccactgtagtccagcmtgggtaacggagtgaggctctgtctcaaaaaaagaaatataaataaataaataaataaataaatagaggggattagcaaatgttaacaaggtgttaaacacacattagtaccaaaataagactttgcctttcctgtaatccaaagaatcaaaagagaattgaaaagaatgactttctcactgtgatttaatattaattaaggtaggrtttccacaccaccagaacacctatcccactttggaaagcactgatctggtggtccagacattcctgcagtgtcccttccaaatgactgtccagcttcttcctgaacatwtctaaagacaagagctctttggaacccatttgtccttagaaaactctaacaatacttttttttttatccaaaataaaacaaataaatttaaaaaccagaaaaacaaaacacaacacctgcctctctggtcctctcctctccatgtgacaagctctatgatgtgtcacatattatttgggcagcttcttttcaaatctatagaccaacaacttcagtcaaatgtgggactcaatgactgttgaaggcagtgagctagaatcaccagcaaagggctttcttaattaaaaataataaatgttgtacctcaaagtacggtcctttggcttcagagagatgacagttacagtaagagtgaactaaagttttgtcatttcgtgtaacacaaaagggctagacaattcttaaatcttcgcatctgaagggtttgtcaagggcttgcaaaatgagtcgaaatcacttaagagaaatttaatatcttaaactatgcattgccatggctctggtgtatgtctgaggcctgtttgaatactctgagcatttatggacaagaaaaggagctgtagatttcaccacctgcccccctcaacacctacccgtacgttgtattgaaaaaaaaaaaaaacagtatctaacgcagggaggaatttctttaggcttccctttcattctctataaaatgtaagtgataagatacctgtgtcacaaggttgttgtgaggatttatgcctggcacatagtgtgtgctcaattaatggtagctgttggcggtaagagtagcagcaagagctgtcttctggcggttcccattgtataaatgaaaattctagagcaagaagacagagcttcaagtcagggacacggaactaaggctccagatttcacaagtctcatttgtctktgatccctgaagcaaccactttcctattaaggtaaattgaagaaaccataaaattaatccggtaacaacatgggagccagcgagaattcctacctcattactggaagggataggtttctgccctgckgcatggaattcgattaccttatcacagctgcataattgtaaatattttcattggttatacaactgctgtgtcttttctgagaaactcagccccaatgtgtaacaccctggattccacggggcagcaaattccacacactgcacccatgttgtgagcggagattttcgggctgaccaaaacttgaggcgaactgagtctccatcttaacactcaaacacacttcatggcggcctggaaacaaggcaatcattrtgaagcttcagcccagttcttctgaaaccaacgtattgggcctgcttcattgtctctctaggggctaatcacaaacatgtgggaagggaagctaaggaatgcctgtctagaaagggaggttgtataatgtagtgggaagaacctatctgtggggtaaactttttttgcatcatgtagaaagcaaatctgggtaattaaatgtttgtgtgtgtgtgtgtgtgtgtgtgtgtgtgtgtatttaggttttggtgaggtataaagccatttaagtctagctataccaaaaagaatttacctttccattacagatgattcattcagtaagcatttgttgaggatctttatatgccaggtgcttctctaggagctgaggataccaaaatggagaagacaagatttctgccctcaaggcgttcaacgtctggttgggagatggactcatgattgcagtattcatggtatcagtgacatgggtagtatcatctcaatgaaggaacaacttagggaaggaacgatgcacccgtctcttgccctgcctctccagtattcgrgcttccttgctgggaaataactctattagcagagaagaagggggtcttttctttttctttctttctttcttttctttctttctttctttctttctttttttctttctctttctttctttctttctctctctttccttttctctctctctttcctttctttctttctccccttccttcctttctttttcttcctttcttctttcttttttttttttttttgccctgaattgttttcctctcacctgagtctttcaccattaaatgcagaaagaaccagaggtggggccctgtgaaattcccaagaaaagtcaacctgaggaacatggcctcacaaatgggwagtaaaggagaaaaggtgcttgacaggctttcaacgacagaaaccttccctttcgaagggagcttgcaggaagggagccaggagacctgaggatctctgggctcatgcaaccttgytaccagagcaggaatcccctctccagcccctggaaagtggccatggagctcccctaaatggtccattcttaggtggtctcaactacgaagtctgtcttctgtgaggtccacctattggtcctaattgtgttatttggcacaattaggatggcagtctttcagatggtctcaggggagcacctagcagtctcttgggcacctaagcataagcaaagtgtcccagtgcttcttctgtgcctgttctccaggacttccaccatcytgattgcctctccaccatccactgtgctcccagagctgatcctggtgctccagatgtcatgtgactgggtagggacagtggtctagatccaatcctctattaatgcaggccaaggttgggtccgctgctttaccagccacgacaaaccattggcttagaggagttaagcttgtggtcaactaaatcctgcagaactgagtgtggaaagatttttgtggcaaaaatggaattgttcttcaattaaaagatcagtaataaaaggcatacggctttgttgtgagatgctgctttccagaaggcttgagcctgtgtgagttagaaattcttatttgctaatttcagcagcttcaagtgagccagagattttgatcagttctcgtttggaagaaatttttgaaaaatttaaagaaaaggtaaataagaaaggaaaatttaaagcttcctttatctctaggaaaaataagattttccacccttaaattatcaacttaataaatctccttcagaatgctgtggaactgcaggtttcttctgctgatatcatggtttccaagagagtgagttacctggttaattctgacttggaggtttgtgcctaaggattggaggtggcaggttggggttggaggtggggaatacttccgaagtgagacactgtcttaggctcttctaatttctagagctcacattctgagaggatgcactgtcccatcagattaattgcactacatagaggtagtgcccagcttccaatccctgccccccaccccagagttctttaattaattgatctgaaatggagcttgggagttgacatttatttgtagttctctagatgattctattgtgcacccatggttgaaaactrccactttacagtttttctagaattgttgttttctggcgccacagtcccccactgttactactttagttgatacctttattagttcagataccccctcttctaggaagccttccctggctttcccctgctaatacagggtckcagaggtgtagatacgtttccaccttatcacagttactgcatcacaatggaatgcactgttaacatgtctatcttcctcatagaggcttcttgaaggtactgtgtctttatctggcacattctttgcattgcctagaggacagagtctgcattcttggcaggacaaataagagccttagcagccttcgcaagcccctctaccagctttattgcctgctgctctcctggcagaaaccctgtccctctctcaacgtcctaatgccctcagcacttcatccttagtatgcttccctcttccctagctccatcagaattctttacctacttcaaagtaaattgaaagcttagctttcaatctttccgtaaagttagccctattgatccctccctggagtacctgtcactgtcactcatacattaccagcacatgctgtcatgctccaaactaaactggagggttccactaggaccatgtttgatgtatttttgtggcatctggagcaaagttcatcctgcctgagaagtgtaccatttttaatggttttttgtttgtttgtttttgagatggagtctcgctctgtcgcccaggctggagtgcagtgacgcgacctcagctcactgcaacctctgcatcccgtgttcaagggattctcctgcctcaacctcctgagtagctgggactacaggggcccgccaccacgcccagctaatttttgtatttttagtagagacggggtttcaccatattggccaggctggtctcgaactcctgaccttgtgatccacccgyctcggcctcccaaagtgctgggattataggcatgagtcaccgcgcctggctagttatttttaatcacaaaagcaatgcattctctattagaaatgacacatacaaatattgatgagcataaagtaaaaagtgaaatgctactctgcaaaggtaacaaccgttaacagtgctagacctgttgctggagaagcagtgtgtggtagggaataagtgttcaggctagaaggactgagttggaagcccagcgtggccacttcccagctcagtgaccttcgatgggctactttatctctctctgcctcagtttctttatctacacgatggggataatagtagtatctacctcattggattgttgtgaatatgcaagttaatacacattaaacatactgcctgacacacaatcgctgctaaaacatcggcactattaatctttcacacrctttgttaaaagcttacacacaaatataccattgtttttatgaaaacggaatcatatgtattgttctgtaatatgctttatttggatagtattctcctatgcagatatgtcttatcactgaatgattagggtatctctaatattctgctctttcaaataattctgcagtaaacttcagcatgtatgtatctttgtagtctatttctgaatgattgatgactaaaagcagagctgttagagcaccaagcatgtgcatgtaaaatccagagagatgttgctaaattacctcccaaaattattctcccaaaaggatgctgttttctcctactccttcagaagatattctccactataaattccatacagttttatttaaagtcatttttattactcgggtggtgcatgaatgcttactatttgtgtaagtaaaatagaaaatgctatatataagggaaaacatgaaagtacgctgcgcatgcacgcacgcacacacactcacaaacatgaagacccccactacattcactctaatttgaatagacttctaaactgattaccctggaaatgactgggaacccgcattccgttataaaaagactctgtgcaccataaagccaagtaaaaagatgctggagtttctgctagcagaaatagacagagagagagaggaagaggtgggggcggctgggggaagggtctatatccagataaggatttctgtggccatgtcatgaattgtatgcctccagaggacagttctgttttttccctctgtttggtatttggtggtcatttcatgataagcagaaagaaaactttgggatagtgctattctctgctgaaggacggatttacctgaatgatcttccaattttgagtctgggtagaatctagggtcctaagtcttaagtgtctgcaaattcattttaccagrcaagatagacttctttttgcttcttcatggtgaagatccttgcaataatctcagatcctcaggctggaagccggtgcattaccccatgatgtacttctttcactaacccatcaacttctatactaccagtgtaacactcttctcaaccggactgcctcatatggggatataggcttgccatctttgtgtttattttttaaaacaattgtttgagtttccatccaggttttcttcaaagggaagaaatttcccctaaattaccaagccagtttcctctcataaggcattggattaagagtggccagtagctgagttttgtgattctgaggataagtaataagtcaaaaagagctgttggctaatcctttagaaggatactaaaagaagagtaagatgatcgtaagcttcctagatccaggctgttaaaatgacctccatattaccaagacttgtcagtactgttaagggaaaaaagaggggaacccctatatataaaaccacaatcttgtttcatctataatacccctggtccccctccttcatctacactgccacccccmcctacacccaccacttgatcattttatagcagatattttattacatttttgaaarcaaaggaaacataagacaggtgtactattttaagattatattaacatatttcatgtttctttaatgccccaacacacacacacatacacacacacacacacatacacacacaccaagagctgatcacttgaacaaatcattaaccaattgacttgcttcccatttctggtataagcttctgtaccagtgctttatattaattaccaaaaccctcctgcagacagagcatgatacatctttagtataggatgatgcaataaaatgtttatgctgtgaaatttggggacaaaatttttcatcatggcataatgtgcatgtatgggcacacatagctttgtttgtttattcttttttcagaagtccttccaattctaaaatgtattgtagtctgacagtgcctctaatattggtaattctttttaagtttataacttttcccgagtttgtttctgcactttaaggtttcttaactaggttatttctagttgagctgtaatttcagtgtatagttctccagagtgtttgtgctaagtgctgaagtttcattattttaaagctacctccctgaaagtatattacaaatgttctacaattgtaatatagtgattcacacacaaaaaaatccctattatcagcatacctaaactacacactaaatatttaagaaaaaaaaagtggaaacattagtagcttttatactggaatcttgccatttctttttcaatttagaatagaatttggttgtcttatcttggtactctatgcttcatgacatatctgaaagcattcttttggcatggatctggaagatagttttagagccagacatcagtgtagtagttctcaagatactgaaaattcataacattcttatgggtataataaaaaatgtttacatattgaattctatgaattctataatataaagtaggagcacacttactatgtgaaatataactcctatgcaatataaaagtaaaattataagcatatttccataaacagtaaaagctattaaatctaagcatgattgacaatttcaaatgttccaatatcatttaggcataatacttcaaagatttcaagccctttttctgctagcattcagaaaagtagaggacaagaaaggatgaagaaaagcttacagtgaaaaaatcttaaaattgagagaattcaatctattaactttaatctataaaccttttttctccgaactgggtacattggcatcattatttgattttagcagcaaacatttgggtttagcttatggaaggcagatgtcctgtgggaacgtgacttgaagtcaccatataacttcccgctaaataaacatctgaactgtaacttgacagctaccaagtgaggtcaagtgtctgaaagtgctgtgtacaccacataagcacgttttccttatgtgaaggatgcatttctagcaatgtgtatcagactttcaagtactcaaaacatacttgctgccaaactttgccacccaccactaacctccatttgatccttagaaggtagaaacttattttacaatagaaaaagagattattttatttgtatgatgtccctaaaattatttcttggtattgatagacctaggtttatcttatttcaagtttgccttattttttaagaggtttattgagatataactcacatacatgcaatttacccatttaaagtgtacaatttaatggcttctagtatatttacagagttgtgcatccatcatcacaatcaattttaggayatttttatcaccccagaaataaagcctgcattcgttggccatcaccccccrattcccccaagccctcagccccaggcaaactctagtctactttctttctctatagatctacctattatgaacatgtcatgtaagtgatatcattcaatatatggtcctttgtgactggcttttttcactcagcacaatgttttcaagattcatccatggtgttgtatatatcagtacttcgttcctttttatagctgaataataatatgatacatacatattgcatatacatggacatgtgatatgtccatataatggaataytacccattcatataatgaacatatcacatgtccatattccatatatgacatgtccatataatggaatattatccattcattagttagatatttgggtttttcctattttttggtttggtttggtttttgctattataaataaggctgctttgaacattcatggacatacattttcatttctcttgtgtatttacttaggaatagaattgctgggtcatatgataactcttcttagccttttgaagaattaccatgccattttccaaagtggctgcactattttacatccccagcagcagtgtatgagtgttctaatttctccactttcttaccaacacttcttattatctgtcttttagttattattcatctttttatcagggtgggtattaaatgctgtctcactgtggtttgatttgcacttctctgaaggctaataatgtcaagtatatttttatgtgcctattagtcattcatacatcttctttagagaaatgtctattcagatcctttgcccattttttaatgggggtggctttttgttattgaattgtaatcgttctttatatattaaacttacaccttgtaaaaacgctgggcactagactatacagggattactgtaccacttgtcataaatcatagctatggtcctccttgagaagaattccttactgtagttaacacctgctctaaataagcactctgaagtgcttcttacaaagggtaacgtgggccaggcacrgtggctcacacctgtaatcccaccactttgggtggccgaggcgggtggatcatgaggtcaagagttcgagaccagcctggccaacatggtaaaaccragtctctactaaagataccaaaaaatagccaggcgtggtggcatgagcctgtaatcccagctactcgagaggctgaggcaggagaattgcttgaacctgggaggtggaggttgcagtgagccaagattgggccattgcattctgttaagccattgcactccagcctgggcaacagggcaagactccgtctcaawaataaataaataaataaataaataaataaataaataaataaattgcaatgtgaataatgaaacatcagtgaaaataagtagttttatattattatgtacttttgaagtaaaacgtctccccccaccccccatagcaaagagatataatagccaaaaccaaaaaggaaatacagtgggatgtcrttagtaataccttttgtttgtcttaggtgtgagaggattcttgctcttatccgtgtgatacatgttttggctaaagctttgaagtcataagatatgtagtctaggtattgtaattgtgcatttcatatttcaaaaattgtaaaattcaaatgttaagtctttggckacactaaaataattgttgaaatcccttaaaatgtagatggtaaactcatcagttataactttttgttgcactaaaatatgastttatttctttagttgtagtgaataaaaataaagttaattacaaaagtaaagcaggtaacacaactatttgaatatgcttaacactattgaactgtacctctaaaaatagttaagatggcacattttattatgtgttttataccataattaaaattttcaaaaataaggcagatataaatattttaatgtcaattcttttgagtggactattctaaatgattatttgcttatcagtctaacttaagcacagttaatcacttttacactgctttgagttagatagctgctccctatcctaaattttactttctaagatgagtaatacagatactcaagttaaccaggatgttagtctgtgggtcagtgatcaggtatctccaagtcaagacattcctcagccgcccctgtggttgtcctgtgaggtggttggtggtgagggtgggcctggggggagacaactgcaacaggaggacctctggattacatacccaagttccctctcaggaatgtggatgctaaaagtgaagtgctgataacaaatctcactggtatgaagtagattttacaagctgcttcagtctcaggctatatctcaatttatggggcggcgtcattgctgaaagttctgtgtaggtcttttaccatagtattgaattttacattcattataatgctttttattatgagctctaattccaagttagttayttttaattcagaaagaaagtaaatatttgctttctggaggtaactgcacttgagtatctgcaaggagagcccctcaagttctgtttttggggatcctccccttttgaaarcactaatcggacctcaaaaccagattttatctttgaggactgacttccrctgccttttttttttttttttttttttttttttgatagagtctcactctcacccaggccagagtgcagtggcgtgttctcggctcactgtaacctccgcctcccaggttcaagcaattctcttccccagctgcccaagtagctggaattacaggtgcctaccaccacgcccagttaatttttacatttttagtatagacaggtttcaccatcttggccaggctggtcttgaactcctgaccttgtgatctacccccacctcggcctcccaaagtgctgggattacagatgtgagccaccgcgcccggccctccattgccttttgaccatcaacaaaaaaggccaaagtgaagcttgctggaaaggctttgtaagccaaccattctcagtaattttggggttgtttcattcgtctttatttggacgaggttaaaatcagttgcacatttgtactgagcattttggagtcctgttatttgaattatccattatttcctatataattggagagttagggttaatgttttcttctatctcatgtcttgaattcccagcagaggctacacaaaatttacttctacttcatataccagtttatcatggtacagattattgstcatttttattcttgaatagagctacaggccaagcaacttcttgcattgatattgatgtcttctttcacatatgtaagtaatatatgtagtgattacaagacattccttttgttcattaaagaaaacccccaggagactctttggagtaagctatgggtaasccactgaatactctttaaagaagcaaacctatatcattaagggaaagctaaagatacgtaagttttttgaagttgacatcaaggagggcagcattgcttggctggtgcaactgccaaagacaggacagattattggtctgacgaaggacaatctggaattgtaaagaacgctgatagaatattgcatggacaagtttagataacaagggctggtatttttcactaacacttggtttcctctgtgtgttttgctttttcagatttatcttttctgtgttgaaatccacacaagggacataaaataaccctcaaaaaaatataaacacaatatccaaaccttttggaaatttaaatgttawgtattattcagtaatgtctgcccactgtagttggacaaaaccacattcaggtctatgtgtcagctttgtccctcagccctgtgatttgcttttggtggctcagggccagctctccaagggcaagctccatgaaggcagacagtgcgtctccattttgatgaaggcttgcagtcaaggtcctcagtgtgtgttagagaggcatagagctctgcaagggtaagttcatgtctataacaataattgacctccctagtggaaagacaggattttcccaaggaaaatagtttgcggtgtcatatttgtggtctctctagagagacaattccgtaagtggttcctaagccttggaaaattctcttttrcaatagtacccacaaataatgttcaaagagytatttttgaggaaaggattcctcacatttttgcaggtgtaagtcattcctgcctcagtggagtacaaagagtgatgtgagggaagcagagctgctggcaggaattttaaaagtatactatatttgtcccacattaactgtgcttctggggtataaaggtcagggatagaactggtcctgtgggatgtttctcatcgaaaccacctctattccaaagccttggtgtcactagccaagatgtatctattctaataaaatataggtctcatatgacaccacattacaaaatacaaattttcatttgtttttgtttatctagtctattggaaatgtgtggttcttttgtagtttcagttaagagtctaatttggtcatttgcctcttaaaatactcttcaagtcctgtgagtactcaacaaacactcactgttgaccaatttctatttccagccacatactgttcataatgaaacctacttagaggatttgaatgaaataatttaattattttcaatgtacaagaggcaaaattatctgccatgaatttctctggagtaaagcatcctcagtccatccaagtaaatgtttccatttttgatgttcaatcaagaaacattcaaattcaactgtattttttgttaagaagaatatttcctttggcattcaaaatgatcccaaacattgcttggaagagagaagtggggagagagaccacatgtattaaagcacatttaaccaattttactttggcacattttgttttgccattccacctatcagtcttctcacaaccgaagagcacttataaacattaagatagaattttaatctttcatggaaggagctttttgtcagcattggaaaaagggagatttgggtcaaattttgactgaagggccatttccttagcaaacatccagactccagggatccattttgttttatttttgccattgaaaactgtttttgagaaaaggcaaaagtcaaaattattaggctttaaaagacagcagtttcttttatcacaatttgccacactaacttcgtggcttcttgtttgtttgtttgtttattgtttttaatttattccaatatttattgggaggagactaaaatcagctgtaagtgtatggtgaacattttggagttagggttaatgtgtaagccattctgcatttctttcatcactgagatttttatttaattaacgcattaattatcatgaagcttactatttggtgtctgcttatctctttttttgaggaccaagcatataaatatgcgaggaatagtgttttattattctaaataccttgccattattaagagtttttttatgattatactgtctcaatgttgaaagaaaaatttttaaagatttgcrtttcaatttttttacctataggcaagactgtaccactctgggcaacaaacttaagtttcagaaatttaacttaggaacttttcaaggaaatttgagatttgtgtcaagaaaccyttttattaacgattaatgtaaaatttggaatacggttcttaagttaatgtgaacctgcaaaatctaccatttttgcctccataataagtcagaccttgtacaacttaaaaatgcattctgtcccacgtttcatgctgtcccttcctcagaatagtctgggagttcagcttttataacctttggttgcccttggaaggtatttatggcttggatgggctttgttcataatcactgtgttcttgtaggataacccccctggccttcttgtgacactgagctactgataacaacttctcacgtgtacagataatccaaatccacattcaaaaagtgcagcgtcatcaagacagacttgaaaaggcttttttaggcatcaacaggtcattaaagatagcacatctcaccatttttcccttcaactacatacattgtgaagacttaatgggggaaggtgtaagattttgatctctcatgatcctgtgttaatggcctgtggttcaagggttactaagattgcaatagaagaaaaaaaatataaaagcaaaaaaatttcccaagaaactaccacaaatacatacttttatactgcacataatgaacattcccractrtacagtgctataattatagtccttatgtatgtttaattgtaaaagtcacacatctaccctacttgaatgaatgtatctgattgactcattggtaaaagattatttatcttgacgaggcctggtggctcatgcctgtaatcccagtactttgggaggccaaggtgggtggatcacctgagattgggagttcgagaccagctggaccaacatggagaaaccccatctctactaaaaaaaaaatacaaaattagccaggtttggtggcccatgcttgtaatcccagctactccagaggctgaggcaggagaatcacttgaacctgggaggtggaggttgcagtgaactgagattgtgccattgcactccagcctgggcaacaaaagcaaaactccatctcaaaaaaaaaaaaaaaaaaagattctctatctctattccgtatctctatccacacacacaaaaagggacaattggcataaattcctatttttaggcttcccaaagaaaaacacaatcctatgttctgttggctgacaagactaagattaaaaagtgacataaagcgtaggactgcagmctttctatagtttattatttgtctcctgaaaaggaagatatttgtatttcttttaggaacttcactccaacagatttattctaaaacaattcctgactgtgttgaaataatgaggtacagttcactttgagaaaataccctaaagaaaagtcctgatcaatgattctcaaaatttttccggtctcaatatacttatgggataaaaagtcattcttctcagtaattaatagtagctaatataaccctttgcttttgtgtttattgttggtgtagagagagcagaaggagctatgttaatttgtatggcttttaaaaactaaagattattctgatatcccaatattcatttcccccagtcctcaacccttgagtgagatgggccttccccattgaaaatcactgtgtgagttttccaaaaacaattaattataatacgttccatcatggattactttagtgcacttaaaatttgactcaaaattttacaagcattgattttactttcagaaatacgtttgtgggcagatgtgaaattttcctatgggaatatcagtctaccttactgttttggggacatccaagtcttagtgtagaggcgggtggggaaactagattaaatgttgagtgaacttgtctactgtttctaccttgacctctaactctcaggtgagggtggaagtcctctctcctgaatacaggatagggattgtctatagtctgagggaaaggctgctttccactggggtcatttatccatctgtaaaagaggatttttctccccttaaatataatcataatacccattatcacttgttaaaacataaataataatcctttaataatgccattagtcagttttcaaaaatccccatttcttttctttctcttttcacagtttgtttgaatcaagccatattcatacattgaatttgtttgacagagtctctgaatctgttaagtttgaaggctagctctcacattctctatcaccagctttatctctgtcttcctttcccacccttcttatttgtaatttgtttgttaaagagatcaggttgtcaggtaaaattagtcttccrcaatctggattttgatgattatgtcaccatggtattgtttaacatctttctctttcccccaaaccattggttttcagtcatgagagatagatataagcattaaaactctatagctgaaatggccttgaagatcctttgtaacccatagcttttaaaagctggtacaagtcaattggccaaaggatattgagttaggcagggccagcctttggcaatgcaattgctgcttcctcagactcaacaaaaattatttgttttctttgaaaatgggaaaaagctacaggataagtcataaggcataagcataactagaattgtctgcaaaataagcttatacacatggtaaaggcctcatgattctaagcctgtgtcccaggttccctttcaagttaccaagayttgcagagttacttcattattatgaagatggtgagtgcatgcagaacaaatgtattcctggtaaaagaacattaacatgatggggaatgcagctattctagatgtgatatataagagtagggaaactaagttttttttaaaaaaaaaaaaaaaaaaaaaaggaaatatagaaactaggggctaaactagtaacttggcccctccttgggttccttccccacaccaggcttgctgactcttcctccctaactccactgccctctactatggccaccatctgcaccctagtctgggcaacaccatattgatcctaatctacactaacttcctttctagtctccctgccatccgcctaccccacaatccagggtcttgctcttttcttacctactttttttgcacaaaggtagcatgttcttcctaaaactcaactctgggctcattccccacattgcttttggaataaagatcaaacttctcacatggctccagcttgtgcctttctgtcttatttctcactcctcctccccaccctcccacccccagcccaaccccactcccaccctagtgtctgcctggactcttttccccagcttcttcacctgaaacccctccttaccctcaggtcttaccttgcatgtcactttctccaggaaacatctcctacacacacagtacagttaggcagccccattgccagcctccacctcctccagccaactgtgtcatgaaaacagggaccattttgttcagctctccatccctggggacagacagaaatcatctttcgagattccagagagtcttaagttattttataaagtgttgtgaaagtctccactttcatgttaaaaagtactatatgctgcataacattyttcagaaagggttattatggaagggccgagggtcaaagttccaaggtcctgaaagtattacactgcttccctgagcagtgtcagaccagaaaaaccaacaccggactcttgactcagggaaatattgcaccctactgccaatttatgtggttggcttttttatctttttaaacaggcaaagagagctttgccatgcttttcctggaaagattcactgattcaatccttcagctaatatttggtggaatgcctactaaagccatggcatgcaattctgccgtaggacatgaagtcgtgtgtgcctgctgttgaaagcagtgagtgttacatgagagttttctgattgccagctagtttgcttccctgacaggcatttccagatgtgaggaaagatttattttggcactcccagctccaagtggmgtgagcgcacacacacatacacacacacacacacacacaacattcactctccttcagtgcttaggatcatcatcctctgccttcaaagttggtaaattgagtttgcgctacagcagaatagctggctgttggtaactttcaaggggagaaagggcatctctccctcccctgcagctgagtacaacagcttaaaaatagaacaatgtgtgtttggtgtgttcttttcatcctctgcatcaataacaggtgtacagttacagacacaaagagctagattcacgtcttctgaagcctccagagaattcccagagttacccatggagcaagaactgggcctaaaatatttagtaaaaagaaagtaacccaatatatctatgtattactaacactgctgtctcacatggctttattcttctcctcccatagtgatccccagatgtaaatgcacagcggaagaaaattttaccaagaacaattcttagcgacattacatacccacactttccccaaaacaaaataaagttaatacctctaaaaattgaactacagaaattggcgtgactgctgtgaatagcaaacttggaaatgctttgggtgagggtacaatactgaacattcaaatgcttccactggataatgcaggtctagcttcataaacccagtgtgagaagtcagattgatttgctagtttgctttttatgcattttctaagatgtttcttcttgttttatgacctcttagaagcactgacctcatatttgccttgagattgaatgctttgcccatcttgctgcacatctgtgatcattaatggtattacttaatgaataagttagcatgtaaatttgcaatgtggaaactgcatcccctgccatcacacttctcagcagctgcttacaattctttcacgttccctccccaaggaaatggttcataacagaattgaacagatgctaggtgtttggcagcattgtgagcgacactggttttcaaaatttaggttatttcatgtcagataattacaatttcaacagcttttaggcctttaatgtgtggcggtgttcacataaatacttaacctctgactccacatttacccctcccaagttcccctaacttatttattggttctgacaacaccactactaaattcttggctctcaaagtcgaatctggtaaacacgcatgggcagatctgacttggcactaaaattgctccttctttctagatgagcttttacagttgttcctgacagcagtcaagtgttgccagaactccaatgtatagtttagtagagtttcccaagtgcctctctcctgggcccctcrcttctgacacacacagatctcttctttctcaacctgatgcactgttctgtctcatggaatgctgtgatgccctggacttgtgagctttgagagcaaacactaggtctttctagagctcctgagagtggcatacaataagtgctcaataaatgcatcccacatgagctgaggataattagctaaaaataaggaaaatattgatgcttttgtttgyttgttttgtttttgagagagcctcgctctgtcgcccagactggagtgcagtggtgcgatcttggctcactgcaaccttcgcctcctgagttcaagtgattctcctgcctcagcctcctgagtagttgggattacaggcatgtgccaccacatccagctaatttttgtatttttcgtagagacagggttttgccatgttggtcaggctggtctcgaactcctgacctcgtgatccaccctcctcagcctccaaaagtgctgggattacaggtgtgagccaccacgcccagcctaatgttttcttcctaatcagctttaatgtcagaagactcaaaatccacatctgaggggttcttacacccctccaggggctgttaggaaacacagtgaaaatggtttgggcatacagaaaacactctgtgagtgggatgagccaatggaaatgttctcgtgctgcagaacactcagtggtagatgaagggtggtttgtgtatcttaatgactgagtccctgctcatcgatatcccaatcacttgacttcktaacacagtttatctccctacttgaaatgttttacctttccccccattcgaaagttattccacacacattcatgaagcattttacaaatgctgcagcctccctaagactggatgctgataacacttctaaaggggcacagactccataagactgtggatgccgatacacttctcaagaggcaccatttcctttcccctagcaagccttgtatagctctgtcccctcactggatacacagaaaacagtcttgaccgagcatctgccatatgtcttcatgctaccttcccttccttgtccccattgcatgtgtgctctgcgtcatgcagggctgctattgtctagctgaggttgttaattcattcagtattgaggccctccagttagctgtgctaggtgcctaagaaggaagtcacagcactgttaaccatagactccaggtcctacatctccttcctctgcagagtgaggagatgtttgcatctgaaaaggtaaacaggggccagctgagtggtgcaggggacattcgctctggctgcatttatttgtagtaattcctgtttggttcttaaraacacaaacttctggagctaccagttgcagcattgactagctgtgggagaagtcactttggcattcagggcttgtttatggagtggaaataatagtagtgacagtaataaacatgtttgttgtatgtgcctcctgggggacctggaggtgagctcacggggaatcatggctgtgagtgtggtctatgtgaatctataggcattggctaatgtcagtgactactacactctgagattctgctttaatattataaacaccaacttcaaaagcccttttggcttctttgccrgagagtatcaggtgtaaggtctctctttgcacttgcatctagtgtctgcctagagaggatcatttcctcagcctcggcttggtcaaatgatggcattctcactggctgtgccctggctttgtcactaattgttaggcagtttcagagatcgtgttgcatgttacttcaccccgtttctgctgactggctgcctcctgagtgctgcttactgcagttcatagatgtttctgaaaactgcttatgggtgaccctgagtaaacaattaaaagtcactgtattttctatgttagaattaaaaaatctaccttgccaagaaagcttgtgaccttgtaaagattgggaaaactccacttgtcataaacttaaccagtttccaactcatgcactaaagcaaagctttaagccactttgccttatcaaaaggccatgaaactttcattctgtcctagcctcaccactaactagtggtgtcattttatacatcatcaagccttttgggttccttgacctcactcaccagacctggagggccccggccagttttaggcatttaattttgactttttgatgacagaatggtttccaagggtgtttgagattccctgtggaattatgttcactacaatcaagtttccattgcattaagatgagtgcaagttagaggaaacacatcacagggtttacttagcctggaacagagctggacgcatgattgctcctcagtaatcagataaataagatgtgatttacatcagaagctgtaaatgactgagaacattggtgttgcagtaaagattatacttattctaccttaaagtactaaaatcctaatcttgattaaaggttaattctataattggtcagtgactttttaattttacctgccataataattgctagcaactactgggtaaaaaaaatatgctggttattaaacatatgtacttgttattccttctgaaaggtcattgttattattcccattttatagatcaagaaactaggtctcagagaggttgcataatgtctcagggtctccctgctagcaaggggctgagcttgaattcaaactcaaatctacgtgtcactaaagccccctctctctagagccatgtaacccctgatgtggtatgtggcctctagattagtactggatcagtttataattttaaagtgcatttgttcccttaagtcttttctccacatgagctaaatatttttcataatttttctgtactcgtgtacttagccctttacatcatgtgtggttgaacattctattatttggtgagactatgactgtctaattggtcagtgagaatctgacttgtctagcaacaaaagaactccttgagaagaggagckactatttgtacatttgcattgcagccctggttgcagtgatgaactcttgctatagtatgttacaaaattatgtcattgatttgtagattgagtatagttgcttaattattctcacctgctgaatttgcagaatttgtcattcatcattcattcaacaaagctatactgagttcctgcagtgttagtcactgggcatatagtaatcaatgtaaaccatcgtgtattactatacttsaagggctgtgacctggaaaatcactgatatgttattccagaatgaataaaagtgaagttgaacttaaggcatatactttaaaagaatggactttttaataatcattgtagcacaaccagaaatttttgctaatgaattatccaattaacttttctgaagcctaaaataattatgctgttatttcttttgcatatgaataacttctgtttgtattgatccttgatgcatttacatctctgcccaaatgatatgacattcctatctagaggggaaggatatttattagcttatacttctctagattgatactactgattcttttaggaaaacagtaattcctgaagttacaaagtcaggctaacagtattcccacaaaacatcttgtaatagcttcatgtgctatagggaatttttttgtttaaaaagtgctccctttctataatcactttttggttgtggaattcctgaaacaatttgttttggttattctgaaaaattctgaatcttccctaatacctttagtaataaaataggacctgataaaaatcacgaagtgtctttgaatctggctgaatatctagacttaatgagtgtttaaggctccatgtcaacctgcaaagatacctggtgaagcacccttatgtayttttctaaaaaaaccctgccctgttccatactttaatcaacgactcaacaacatagaagtcatctacatagtgttttcatacgacataagcccaaaaaggatggcttccactgcatatgcctgtgatcatgattcataatgatttcaataggctgcaatgctggatggaaaccaacatgatgaagttgagcaaggaataagtgtacatttctgcttttagattcaaaaggcaattgcgcaattacaggatggggaacaactgagcttggcagcagttcatgtgactaaaggcttaatgtgaaccaacagtaggaagtggtggctaaaaaagaatgaatgtagccgtgtgcttcctcagtagaaatattaatagtcactgtactctgcgctgaccgcactgcattgggaataatttgtttggttctgagcacattcaggagaggctttgacaaagcagagtagctactaagagggtgttgaatccaatccaagacacatttattagactcctgttttgggcaggcaatgtgctaaccagggcaggcaataaagacacaaagagactttgccagtctctaggctcaaggagttgaaaatttaaatagagagtcagacaggtacacgcatgactataaaacaaagcgccccacgaaaccaagaagcacaaagaaagggttgtgggaattcaggggctgggctagtggtcagatttccacaggaaatgaggacgagagcagaagaagccttaagagcaaagagacagagacaggaaaacccaaggcatgtctagggaatgctgagaagtctgggttgcctggcagaatagggtaggcctgcgtaggaaatgaagctgaaaaaagaaggtttgggccagagcgtgaggacattgactggtaggcagtgggaggcattacaggttggtgagcatctgaaaaaaaataatgatatatgaggatctgttggagaaatgatgcatattgagtctatagaaaagaagaccgaagtcccctggtaaacgtatctcagacttgctttgggttcctccagaagcaaaaatttatctcaaagggaaagggttaaaaggaatgagattttagatttctaagcagttttttttgtttgtttgtttaatcaaagctgcccatggtgaagacttaccttagaagattgtgagcaccattgtggtgggactcagagaaagtttggtaactgacactctaaacagagttgggggagaaatgctgcagcttcaccaastggcctgggcattctagggattacccatggcctttgcaatgtgtaattatccatggttgaggtttttttctttcttctttgacttaagacatccattagtatgtcattttctgaataaagccactatgttatgactctccagttcaacgagagatgtcaaactaactccagtgcaggtcccagggctgtgacagtagccactcaccatgactgtggcactttacaacttacccattttttttttttactgtgatatatggcttcctttcaaacatgactttaagcagattactatcacaattccacattggatagatcaaatgcacatcaatgattgataccagtctagtgtgaagaagaatttattttacagaaaatctccaagacagtaggcataatgatcaaacagtgggcactggagttggagagacttcagatgccagcaatgccacttattagctgtgtgatcctgagtgagggacttaacctccctgtttcctaatccataaatgcagagtgaccattgttagcctccaccttgaagggttgttaggaggataaaggaggtgaagcactcagcacagtgcctggcagtaggctctaatttgactgagttcttatggtttacaatggtgttccaaggagcccttcagagctaaaaatccttttttaaaagcaaaaataaaaacatcactgtcatcatgccacatattattaaggcatcacgtatgttaatttattgaattctcaaaaacatccatttgccaagagagtgagggattacataccttgaccagtcacaagctgataartggggggagccaggattcaagccaagcagccctggagttcatgttgatgacaaccatttccttccagttcgtaccaacacgtttctgttttcctccaattccattccaaatcaccccgctagataatttgatgtgttttatttgtttaggccagtttcacaatatttttttaagtcctgttgactgtaataaatacatcaaaggcttaatgtttatgtcctttgccagagtatcaagaaggtccttaataaatgttgaaagagtgcacgaataagtgaaaaattttaattgtaggagtaatttatagtcacttttagaagaagcatgttatcctgaatgtaacttcactaccttaccaattcattccattatttgtgatgagccatagtcctttgaatccttcatttaaaaatcattgttttgtacctggcttctctttaccttatgtatagttcttctattccatacttctctttaacaacaatgtccccagttctatcactcgctgtctttttaaatcatttagtgtgactatattttactcaaatatatccatctaccaattgtgtttgttccaaaccctggtgactgtatcttcatcactcactctattcctaaattccagattaaagaattattttaccaacccgtctcatgcaactcaagtcaaccaaatgttacttccacatcctttctctatacgccttcctagacccctgaaatctattcaggataagtgaagtttgctataagggactgtccacaattttcttgtataatttttgggattcctaaatactccttgaaaaaaaacattggaatatgaagctgagaagaaactatgcacgtaagtattacaaaactaaagtagaatgtgcagaaacaactccctcctagagaaggaagaaagctacaaaagtgttatgccactacttgtggaatatatcagcaattattcaattccattgctgcccttggacctgggggcaaaaatgtagcttttcctgttccaagggaagaatgttctgttacaatggtaaccagaaacagggaagccgaccaattctagagtttactccgacagtgttttcactctatgcagtaacactgctttattgtttggctctggtagctgagagaacaatctcccactccctaggtgagactattcttttataggaactattcttttagataaaacaaccaatgagcttttaaatgctgagaaaactaatcagaactgaaagggggtgccgttggccacagctcaagaaatatgctgactaagataaaagccccttctgaatttttctccatcccatcttcctttgctttctcatctcccttccttttctctacgttttctcttttctctttctcctcttgtcattctctcagctctatctccacaatcttccctttctcctctcctcagccccagctctatcaccaaagatttcattttgcacactctttttactggccaaagtgtggacctgaattttttaaatgtattttcttatatagtagataagattcacatctctggatttaatttaaaaaatagacaaagtggtggctcatgcctgtaatctcagcactttgggaggtccaggcgggcggatcacctgaggtcaggagtgcgagaccagacaggccaacgtggcgaaaccccgtctctactaaaaatacaaaaattagccaagcgtggtggtgggcacctgtaatcccagctacttgggaggctgaggcaggagaatcacttgaacctgggaggcagaggttgcagtaagctgagatcatgccactgcactccagcctgggcaacagagcgagactccrtctcaaagaaaaagaaaagaaaagaaacaaggtgaacatgttttattcactagttgcttttttttctttaaagaaatacatctgtttgaaaaatcttaatttcagtttcaagcaacaaacaacttcagtccatttcagagtgctaacgttggaatctggttccagaatctttgcagagtgtgggtgggcacaggtkcatgtggctcctttggccataagaatctgctgcttcccagcctcatgactgggcctggagtcacactcctgcttcagctgttctttggcaaagcagggccagaatgaactggtctttaacattcatatattgctttcaacttctatgaggctttcatttcaattccttttcttctgtgagggacaggccttccttgggaagaaaggtcaccccttgagtctgacatgctctgcagtcartttgagaagccttttggttaattttggacaagtcaagcctggtggtggaattcggtcccatttagcattctgccagctaggaagcgtgctatctcgatcatcttcccaagacagtcatgcgggaaggtcttttcgctaacaagaaacacaatccaaagtaaagacagcttttgtggaaattgcaaactactcatccagtggtcagttgtaaatcatgattcttttggaaagaaagggagacaggctggggctctggccctcaaagaacttcctctcattaaaccaaagcaatttgctgctctccccaggctctttctgtgcgtaaattcacctacttttcccgccaccatcagtggtcctggtgctgctggtgaatgggcatcatggggagacagggctttccacgtgatagargtttctttccaaacccaggctttacaggtagatccaagggtggctttcgtcagcctgttgcccccactgcccaacacacactttgctttttgctgctattttctgcggtcctgggtttctaaatcttggcaagaggacagtcattcctttgtgctcggctgttacaatgaggtagccagagaaagggtcttggtctgaggctgtcagctgttactaatcacgactccccggcccatggtgggtcccgctcgcctctccctcttgctctgcttagcacacataaagaagatgaattactctctggttcctcttcaaaaaagcatattgtgcggcacattccaatacagtgagcgaaggatgggctcatgtgaagggtaaatgggtatccaaatcacctcgcagcggggctcgcgccggcagctgtgggcctctgagaagtgaatttcggagctgccccttctgagagtttccggcgacctcgctgagagtgagaggaagtccctgcggtgggccctctggcaaaccacataytgggaagatcgcgggactgtgttaagctgtcatgagagtcaattgaatggtcaagaccagcgtagacagaaataaagcttgaccactcagaggccgccatgggctgcttacccgggagaggcagtctccaccccaaaggttaagccaaagggcgctagaagttctttgatgttagaagtagcagtggtggaagttgtgcctcagtttcctctcattgcttccgaattaaagttcatcctcaaaggacgactgtagccagagaaaagggattgtctgcttagtcctatcagaccgaggatacagtgatttagttgactttttctgccactaataatactgtcttcgccactgatttttttctacttaacaatctttcaaaagagaatgtttctcttttgcttttctacacttcattttcttttcttgtttgtttgtttttgtttttagagacggagtctcgctctgtcccccaggctggagtgcagtagcgtgatctctgctccctgcaacctccgcttcccaggttcgagcaattctcctgcctcagcctctcgggtagctgggattacaggcatgctccaccacgcccggcatttttttttttttttttttttttttgtattttttgtatttttagtagagacggggtccccatgttggccaggctggtcccgaactcctgacctcaggtgatccacctgcctcagcctcccaaagtactgggattataggcgtgagccaccgcgcccggccctgcacttkgttttcttaaggaacactagagcttgaagaaaaagacgtgttgacaagttttaagggtcaaatttaaaaatcagtttccctgataaagtatgtgccatcacacgtggcaaatctgtaaggaacacttggtgttttcatgtaatgtaatcttataaggctaagctgtgttataggctaataaaatgtcatttgtgatattataaacagccataatgagaaggaacctttgaccagggtgaaaacccgtgtgaaaatgcttgtgactgtgaattctgcaaaatcgttctccgctcttcatggagatggtttcattctcttcaccaagaatcactgataaaagtaaattgccttctttgctcaaaattccgtgaagtgaacctttctaaaatgtattcccttgttacaatgtccataaaatttctgttcaagtgaaatgacccaatacccaaggtcactatcctcattctgtggtctccactagtgagatgaagcaagttcttgggtatggtggacagcccaagatcataggaaacaaagatggtaggaagggaagacaataaatagttcatggttcctttttgttgctgttgttgttgtttttagacagagtttcgctcttttttgcccaggctggagtgcaatggcatgatctcagctcactgcaacctctgcctcccaggttcgagggattctcctgcctcagcctcccaactagctgggattacaggcgtgcaccaccacacctagctaattttgtatttttagtagagacagggtttcactatgttggccaggctggtctcgaactcctgacctccagtgatccaccctcctcggcctcccaaagtgctggaattacaggtttgagccaccatgcccggcccatggctcctttttaaagcctctactattaaccaaatgggggtttatgccagtgtttacaaacatttttttttttaccagaaactacaataataaatatattttgtattgcaacctggcactcacacacatacacacagagagctgaaaaaaaattctcacaaaacaatacttacctttaccacatgtgacacactgtgatattttctattcactttgattaattgatgaaaatactagttatgacctactaaattgacttcatgaaggcacacatttagaccacaggcctctctttcattcccttctctgcatttctattttaatttactcattcattcacctgttaacatatggacagatagagctatagcagttacttctataggctcatctgcaagagggaaatatgttagcaaaacagggaaaataatacaggtgtgccagagagaaggcaaaggaagggaaagcaatagggtgcccattccatggtggtgagtaataagtggaagttttccagcctcctggccttcctgagcagcttagggccaccttgccgggaactcattcccagctctggaaatgaaactccgggtgccgctgggtttgcattgacactctttccccacaaggtttgtctcttgttgttccagacagaatgaacctcattattttggattaattgggggaagatcaaccaaaattagtgagtcagaaytaaagagtgttttaaacaaaagcaactttagaatttgtaattcatatagtaacccaatctaagtgttagaaaaaaaaaaaaagcatgtggcctctatccagcatagcaacaaaaacactaataagaatggctggttattcaaaaaaatgattattgagcccctctatgtgcagacactatgctaggcactgaggccactgcaatgaataaaacagatggtcccgctctcttggcactaaaattctggtagcaggagacacagaatgaacaaaactgtcctttatcaaggacctactttgtaccctgtaaatatgttttctctaatcttgcaatgtagatattgttagtgtattttctacatcagaagtaaggcttagaggtgaaataatgctttgtgaacagcttgtttattatgtacctgtttaataagtaataataacacctaacatttgttgaatgcttaccacgtgctgaacactactttaagtgctttctatatggaagcccctttaatgccagtgaaaaccctatgagggagcttctatttttcacattccacagaggaggaaastgaggcttggagaagccacatggtaccagagccaaaagtagaatccaggtattctaacgtcagagtctgaactcttaaccactgtgccactgtctcttagattacattccgaggctatcactggcttactaactgtgatgcaaaattgtgacataatcattctttaccaacaatttggaatctaacttttaatgatttgtcttcggttccagaacccttagaatcatagcactttgcagtgtttttayaagctagtctataaaggggccagaagaaaatatttttgcacagaaaaacaatatagttctagagagagatttgaagtgactttctttgtgctccctccccacccctcactgcctttcctgggtgagttttttcaccctcctcctcactctcttcctaggatggcagtgtaccctggactcagcagtgggcagctgcctaggacacacggccccatttttcaatctgtaattatgaagtatattgtatttttagagtttgattttcttattaaaaaaacttatattcacatgaatatggtacatattagcactcatccttgctttccttgtaagtttgcccatcttgaaattctaggagggttgagaacaggcgtctttcattagatgcgtgtatgagaaactcattgtggagaaggggtacatctaaaataaaataaaaactgaaacagaacaatcttcttgaatcagcagttgccatcactcttttctttccttctggacctgttccagtggccctggaagaacaatgaaacatcatggggataagtgggaagacaattcaaaacagaagactacttctctagattttgtgtttcaaaaccagagatgggaattgttgaggggagtacactgatacatgttaatgtccaagtcacagattttcagcagacaggagaataaaatccatgccaatgatggaaacttgggaacttggcacattttatgttgtcctttaatacttgactgaatgtatattttatttatccaagaagtcatattaattattataccataagagatctaatttaccatatagacttacagagtaccacatacacatttccaaaacattccctctctgccccctaaaatcccatgaatttggtgcatatttgttgtgacaaatcaattgccaaaagactgtctttataattacctatttgctcaagaaactcccttcctttcctctctcttccatgtgattactgcctaaaatactcaggtgtttgaagcaaagttttaatcttttactttctagaaagcatcttattcagtctccttctgatgcttaactcattgttgaacagaaataggtttggagaaatgattgcttgcttgataagtggttatttatgggtagacttgtagaaaagaaaataagactcaagtgctcacagcagccagcaaatatccacggctctccaccctccattaaacatgctctgggctgtttttctaggaatggtgaagaatttgcactgatattatcagctctctagctagtccttctggtgaccagtgttaatcagcttgatcttaaagtaggtttagggaatactgagtaatgggacagagatttttcacaattatattcctccacagaattatcttcaagccaagtggctcatcttagcaattaactcaaatgcaagaaagttagagaaagtcagcatggataacaagcaaatgaaacatgggtgactcctggcttgtccataaaaagagacgtatagcagtaagaatactctcttggaaatgtgggttcaaatcctgccactgtcatttattagctgtgcaatgccgggcaagttatttaacttctctggtctcttgtttcttcacctataatatagtatcaacaatatctgcattatacaattgtcatggaattaaatgaccattaccatcaatcaaagataggacttagcgagtgagtctttggaccacataaaagttaactcaaaatgtacaaaacacacacacaaatgtgtcattgtaagtgaaagagccatcatggtacttataacaatagtacaatacagtatttctttggatttcaggggggtcttgattctgaaggcaggttgttttcataataaagatgtcatgatgtcttgaattgggctagtttagctaagcccagatcaaatgaagaaaaagaaactagtcragatcattatctttaccacttgctctggaatgtgtttctcaaatatgtatttagatgaatgcatggctgtcgyaacacactcccacaattacctacataccaaagtaacttcccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaaggttcgtctctcatatttcttgaggttggggaaaggaaatggtcacagagtttaggtgagsgtgggaaagtgatgccctgctcatttggggttttgtcttccagagttcttcctccattttcctgatgccaccagtattaaggccattgtgtgtgaacagattgcacacatctgtcctgctgttgccctgatgacagtgtactgccttgttcctggtggtctcatttgttttacaagctagggtacctggaacagaggtggtcaagtaactctgtgtgggacttcgatcctcctttaagggaaggacctacatggagatgtgattaatgaatatacctcccttacctttcttggctgaaagaatagcagctgttactttattctctttcaaaggataagggccaatatgcagaggtgagtgaggcctctcatttgatgattgaatctccttctgtgctttttgggaaaaaatgccttgatggttgtcttcagctatttagaattagaaagtatgaagaaaatgttttcatattggtttttactttaaacattttttaaaaacctatgaactttattttctagagtcgacagccctgtagccgtgggtattgggataactttccctatccctctccctatggtgtgagaagggacattaaacctcatcctttgtttgccactttggtttccagtgctctgccttgaccacttagcactctctccgaatagctgtaggtcgagaatagtgggcaggagcatcagagaagagttggcgtgagaacggaacagcaccacaaaatagaaggcgagagggaaaaaagcatctcggaggaagaaaatactgccgcctggtactccctggtacccagagatatccggcgtattgtgcttacactactcgccggttccacagggagagagccggaagaattgcaggctttggtggtgacaagttcaggcactcatgggaaagagagtgggcccctttctgagagaaatcattttgagcacagccaagccaagatattttgagatgtgattcagacctgagaatgaaactgcggggggatgggatacttcggttgggaacagattagcccatttttaacatagttgaaatgttgaagtggtgccatcctaacaaatgaatacttagccccgggtttcgagaaagtggccaaggataaaagaggctaagtgcatggcatcaaagccaaagctggcctccttatctgtgggagctgcagytggttttctcagaggcagaaagtacactgaacctagttacataagacccgagttcaagttcccactccattccacttggtgttaagtcctttaaactgttacttaactgctttataatctgcattataggttgttaaaaataagaacatatgaaatactaagggcttataatgaaaattataagtgatacgattcaaatacgaatgaaattataaattgaaggtcatggcttcaatttccacttaagctaattacctttgtattaagatttttgagcaaacccarccagttatctggcaatcgtagacaccattttaatcagtactttaccttctaaatatgcaaatatttagagttcacacaaactctaaatatgttcatgtgaacagggccactacctgaatattaaaccaccattagaatctgatactcgtcattgaaatacagcataaccttttaatacatttgtggaaacaccattttaaattgttaaaaaaaaaaaaaactcaattaactgtaattggattacactataattggattttagtgggattggggaggataaagaatgaagaaaagtgaagatacagctaataaaacagaagagctcatattaatatagataatttaatcttttgagagttttttgtcttttccaatagtttttcagcccaaaaagcatggaactgtgttccattagctacagcctttaggaaaaccttaaaagtcatgcctccttttttctctaggatgacaccttgcctgaggcagactttgaagatgttctgaaaatgagggaaagagggatatttagcatgagatgaggcatctcagacctgtgggacaaagtagaggaagacagggtacaagaatgagaactgtgccatgataatttttaaaaattctttgattggatgagatgaaataatagcagagaaactatttgagaaccttataagccaatgtctactttaaatgcaaattgaagatagatcaccaggtgatcagaataatagcttaaattgtacattaaaacatcaaaaaagaatcccaaatacatatataaaataattcttttgaaagaatttaayggcagttaatctgtgtgtgaatcaccagagtgcttgaacttgaggtaaacttagattatcctgccagaaaaatgttttaagtatttatttacacacacatgcacacaggcacactcacacacgcactactcacactcatagcttccccaactaacagtaacctaggaaacaatctgattgcacttttggaccattagagaacagtattgatttggccatgtgaaatcaactcttggggcagaaaatgagtgactgcatgttcactgacactgctgatgcctcaccattctagcctcggccttttcccttcaccttgtgagatttggggccaggttctcacaacaygtacgaaatcccatggctgggtgggataagggtaggggagtataaaggaaatgctgttcccattgttttccactggagaattccctggactgacttcctgaaaatcttctgtttgcctccaccaggaatggcggcgctagatagtaargcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggtatgtccttgcaagcccgtcctttggggtgtattttcgccatccagaccctcttactggttactattcaaaccctggaaggggtgtgtgactgaaccagccttgccaggcttgaaatgaaggtcatatatctttacctctttcttatagaaattgaagaaaggatccattttctgatcttgtatgagagaggcgaaaagagcaaggagaggatatggattttgagagccttgcttttcggattcagaatctggtcactgacctctctcaactatgcagctcaccttggaattttaataattcttaacctatttttcttaactgctgttctttaaggctaatttttattcaagtatgccctattctttggacccttctgattttgaacttgtgatcagtatcattgcccactatgcacaacgcattatacacagtttggttccagagggactttagagatcatcttgtcaaacctgtcccaaggttttcctttcatratgtttatggagaaagaatttggcaggtctgtaataaaagaataaaggatggcttctttagcattgttttacatacaaaccatacgttgattacaaatgagttttatctactacttgaagcagacttggtaatagagtcagccttatgtagaactgtgaagtaagccaaaatccaatcccagcaccttcctgcttcctctcccctacacacctgcccttgctcagtcaggtcctggcaggaagcataccacatactctaaaggaaccttgaagaaggtttgccaaggtgcgggcagccttaaaggaacctacaaacgatggtaaggcctcaaagccctaacagtaagaaactattttgttaacacccttagctatgaaggagcaaagggaacccagaaagagctatagcctygggagggaagggcctcaggagccctaaatggaggaagggagctgccacaaaatctgtcaaagagagctctgggagaatatagactccctctgccctgtgatctgtcagtgcatgtcactagacaaacctaataggagtaggaagccagagggcaagagaacccatgtgttgtggtccatagaggcctggatcccagggcatagacagagtggagagtgaatctagaatgacaaaggaaagatatctcagcataggctctagatgccccatctgctcagcattcccccactgtttagtccctcccagcctgtcttcccaaagactagctctttcctcccagcttttcagctaacttacctgcagagtgattgggctgccaattatagatacctgtctaaagggcccattccccattgatcttctgaaggaaattcctctatgccatctyaaggaatggggctgtggcaggtaaagccaagagagatttggggagcagagggtaccttcagcagcacctctcaattcccaccatgggtgactttgcaccatctctatgtatgtaaacactacccaaggggcctcttcttgaaagtcctttttcagggagttaatcacaatgatctgcaggtatcaagccaccctataacattatttcataccaagttgacattcaatagctatgtttttatttagttcatacarttaattaaggcttttcaccatttctgcatgaactttaccctcagatagtttagattagaagtattttattatattacattttctttccctgtaatttttattccttgtttgaagaattggaatcttgtcatccccagtctggttgatccatcagaagactgtgtttctgccctgccttgctgcagtgaaaaatgtatcctgcctacaaccaatcacttggtttgaacatttatcctggaatctcctgaatgcatatttctatcaaggttgatagcaacaacctcatagagyrtagataggaaggaaaagaaaacaggatgatctagtaggaagaaagggacaagcatttataatactaaaatataactttgataacgtgcaactgctggattcttgagcctgtgataactgctggatcatttctccttctcccatagtctttcatcttggagctctaatgatagtttaatccaatctcctctttaagagatgagtcaaatgagacataaatgggtgccatgacttggccagtgtcacacagctgatgacagacttcccagccagagtgttgtccctcactctaccccctacaaacacaaacagtgctttgacaaagtctctgaagaagtaacaagtcctgccacatgggcttcaagttcaaattttgcaggtcatctctccattggctaccaaagagttgcagaagctttagcaattcagtgccaaaaccccattccccagaacgcctttgggaggcttttctggagaacaaaattccataggctgaccatggcttttgattcagaacatttggttcctagacacatggcacaataaccaaaatgaccactgctaaacaataccttagttagccagaaagctaatgataaaagtcatttccagtcttactttgattattcctagtagcagggtttttaataatataatggctgagtgaagaacccyattggctgacaagaggataaatgagtcaagtttggactcccctgaaaatatgaactacatgggccacacttagggaggaccatatattcttttcaagctgtaaaatccactaacatttttgtttttccatttgttgcttggttcaatgcaatctttaccttacacayaatgaaacagaatttaaggagcaaacttattacttggaaaattttgcaagtgactattactttctttgcaggaacatgttccctccaaatctggtagaagcctgctttaaacaggtaaacactctacagacattaacttgccttttaaattcctcttttctataccaaaccaagtgggaccctcttttccctgctcatttctctgctataagaaacacttctcttgtcaaccagattaaaaacactagcrttttctaggaattttggggggaaaggatggttcttaccttgtattgaaagcttagtagttgtcagacacagtgtgtcttgcatacaaatatctcattgagtctgctattgttaagaaggctaatcacaagacccccccttcctatcacccaactccccactggcaaaagcccaccaaccaaacaaacatcaatataaaatatatttataacttgccttaaagaagattagagagattatttagatttctgggtttgatttaaatatcaatggactgttttttttttcaagtctaccaagcacctaatggactctaaaggagagccaaagcagaaaggaatggcatcatcattcatggaaatcctgctatatgccaagcactaacattatttttagtcctcacataaatactataaatatcattgtcttcatttcactgatggggcagctcatctataagactcaaagcaattatgtatcgtgcacaaattctcacaagtagtaagtgggaagactcggaattcaaattcattgtgttgactccaaattctatctgctttctgctactccattctgcttccatgaaaggaatattcagggcgatgagacaccgacctggaggctatactgaggtccagctccttttagctcatatacaagcaactcttggctctgtgttgcagatacaaataccttttaccattagaagataaaagctcactttaacctcacttgaatataagagctttgttgcctaaaatattaaaaggraaacagacactcttggttaaataatatttcccaaacatttctccagatggtgtcaattcactcctgttgtaattccctaacgcttctgcttaggatctgtaaaacaaaccaaacaaaaccccaacctagtagaagactggattttacacatataagtctccctttgttttttttccccttgtaataatttttaagactatttttaatatgtaatgcatgcacacattgaaacattcaaaccaaattctttctttaaaaaaaaaaaataagcctgaggccaaaatctaactttctttgttcaaaaacaactataactataaataataagcgcctttcaatccaaccagccaactctagcaccatggggctgacgattccagtaagtcagctggccctgtgtgatatcaaaaatgctgatttccagatccttcagatggaaaaagtgctgacttgtacagattgattgtgtttgatttggatttgcattcacaggattttgaagggaaagaaaatgtttctccccaggtctagttggcttagaccaggatgcaaacaaggttgcagtttctgtgcatgctgcaaacagagtctaaggggaaygagttagaggcataagaaagcctgatcaggattgaaaatctgccctggacaatccataaaatgcataaggacccaacggaataaagaaatttgagagttggttggaatagatgaatggggccaatttttttgttgcttgaaattaccagtgctactaactgttcatgaatgtgtccatagtattgacagctggccatggctttgtttgggagtagttgtttcccagtggataagaaacttttccattaacccttggtaaagaaatgaccaagcacttcatatacagcagcactttcttcccctagactctagattcactcaccatcactcaccattattactctcactggtgctttccctacaatcaccatcaagatcaggaattctattctcattaaaatcacagagggatgagtttacttgtttcatgtggccagcatctcctgactggggcatctatgyagaaactgaatagatgatgggaaaaagaccatctcttgagttagaagagaaaccccactatagacttggagaagatgagctgtcatcaccaactattaatcaggcacctattcttaagaactaataacatcaagaatggcttggaaacagcttgtttagggatttttaatttgtaatacccactgaaatctctaaacaggtctaatccctraagggctttttcattgagcaccattagcagaaattagtacaatactttaaaatttgcaagatgttctcctatattctgtttaatttgattatcacaacaacactgtgaggtagaaccagcacaactgttcttgtttcacagctgtagaatrtgagagaaaggataccaggtgatttatctattataccatagcaygatccccacagaaaagaaaaggactattgtgaatatttgggtttatggttttaaaaaaatcccattatagtcattttattagggtttcagaagaaagcaaaagcacatgcatgtgtttagtccagcatctttagctggatatctctttcctgttatcatttgttatgtatttgagtgtgtgtatgtgtgtgtgtgtgtgtgtcatgatttgtatgtatttcagtatgtgtttctgtctgtctgtgttgagaaactagtaggggtttgccacagattaaagagagagagagactttctataacactcatctctgaatacaaagtaacagagtaacagtaatcattttagaaaatttgacaataggaaaatataaagaaaaaaataaaaatcacytttaatcctcgttgtgctttttatttttaagtttaaaaccaactatgagaagagaagctttaaagtgcccatccaggccaacgaaacgcttgtgggtgctgtgataaacaatgtgtctgasgccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgtatttccattttctatatatgttatatacgagatggttattgccatcaacatgtgttctgtactgaggaaggtgccacgaggcaggatggccaattgcagttatctcactctggtaagcccaggaaaatcaatgaatctctgggcctctagaggccttgaacctatctgcaagcctcttctaataagtttgcttccttgttttcaaaagctgtcacctccttttaccccagtgctgatggaatctcattcctcatttctccattttttatctagtttttcattcaagacataattattgagtgtctactatatgctaagcatatagtgccaggcactgtggatatagcaataaagaaaacatacaaggatattccagatcttacactcttttaagggagacagacaataaacaaacaaatcaatcaaccatatgctttagtcacaggtgctgtggaaaaataaaataaaattgcaggtaactaggagaaggcacaaagtttgccttggatggtgcagaaaggcctctgaggaggtgacgtactttgttaagacctgaatgaacagaggaagcagtcataccaaagtgccagaagaagggtgtttccagtaaagggaaaagcaaacggagaggccccctaggccatcaggaaaactgagggctcctcatctgtttcagccctaagaaagaaatgtaaatggcagttctgctgcaatatctaaaagattcacaggaagtattacaaaatgccaagccacaatttataacaaaatttgctttaataaagttgacagcaggagacaaaggaagagactataaatgcaagaggaacattgaccttggaaagtaaactttacccaacggggagagaacgctttgattgacctargctttgtgtggaggttgcttctctttcattctttatttttaatccagtctcctctgtggtacctgaggcaggaaagcatccattgctaagaaaagyactcagtcaccaacatgattaaaaatgcccttgtctttaatgccaacaaagcccagagaaatccatttttcaggaatttgtacaagatggatatgaacttgggcacaaagacagatcagaatgtggtctccacaggagcccccacttggaaggctcctttgaaaccctggcaggaatraaagtggacatttatcttcatattattaaatgcctccacctttcacctcttttatgaaagaagcccattcaaggccactgaatgaayctcacatgcagcttgtctagctgtacattcgcctgcacattcaacgctgagttattatatttctgaaaacaggtattcctatgatttcctggcctgggttcttaaaggacttttgaaagaagcattgtatttttcgatttgaaacaagtcctccatagttcccaggagacccttcttcttaagtgtgattggcttctctgtgtttggtaatgtgagtttggttgtagtttgctgcacatatgaaacaaacagaagggaaatccaggcagcgaggcctttaagcaaactctaggttatttcaacatgtagaaatcattttgagtctcagtttattgtctgcagaaggaaagctcataaatggcagtagcagcctgtggggaataatgacttcattagaacacctataacctgattgcagtagtacatacatgcacattattaagtttaataatgaatttattttatggacatcttctawttatggcaagtggtactagatttccatttgtactataacatagaattttctcttaaagtaaatttacttaagtaaaaaaggtgatctgaagaataatactaagtaatcttgtaagtggtatgaagatatggaaaggcaataataaaagtggcccttgaataagagaactgactgcaaacctgagacactggtgtagcatcgtgtgcctcttgctttaacttgggaatcaggctctgatgtggaaaatgcttccaaaagtctggatattggtacagtggattccggctgttcaggacacttagcaagggagcaggaggcagagggagtgagtggcatctgaggaccagaaaagtgacccccatgtagtgaaaggagggctggctaggaagacagaggtgggtatcaaaagctctgtatctgccttttcccccaggtctaagagaaaaayattgtgtcctagagcaattctcagtgaggggaaagcccgattctgcaagaatcaggggaaatttatatttacaaaagaaaaaaaagaagtccacagtttctgtaagaaaagaagtccacagtttctgtaagtcctaatggtatcctgggcaggaaagtttggcagtcaactctcttttccctttttcttatcacttggaaatttctgtggactagcttggtggaaaccagactccaaccgtgctggtgttgcttctccccaggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaaggtatgtatgtatgtgtggaaaatgagtctgaaatgttaccttgaaccagggcccctcaagtagggtgtaggagaagccattttattctgagttttaaacttccaagaatgatgagttagctttctcatttctgatgtcaatcacacctgtttgggattcaggraatgcctggctacatatcttttgtggggacaaattggaaatcaactatcctttcccgtccacttcatctctctttagttgacatttgcctgagggagaagaggcagagtgacttggcacaggctgtcgtgatgagggcatgatcacaagtgatgcctcacagaggaacccagaagcaggagagctgccaaatgaccccgtgaggggaccacactgttcttaacctgctcccctayttatacaattgctgacttagttccctttaagttagaacatgggagaggaaggaactgtctgtcccaaagaccaaacgcacagacagtcagaactaccaggacactcagctgatgtgccctatttcactgttctcagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcaggtacaaggaaagagttctatayaccctttcttaagaatgyctttaaggctgggcgtggtggctcacgcctgtaatcctaacactttgggaggccaaggcgggtggatctcctgaggccaggagttcaagactagcctggcaacatagtgaaaccctgtctccactaaaaatacaaaaattagccaggcctggtggcacgggcctgtggtcccagctacttgggaggctgaagcaggagaattgcttgaacccggaggcagagattgcagggagctgagatcatgccactgcactccagcctgggggacacagcaagactccatctsaaaaaaaaaaaaaaaagaatgcctttaaaagacaagaggatgaccagggttgggaaggggatcccacataatcaagaggtggggatttggggtaatcattctatatttaggtattttaattggtttttttagattatagatgtatacactcattaataacaaggttcaaaaaatataaatatgtataaagtaaaaagggaaacttgcctgccatcacatcgctccacawccttctgtaagtgaccattgttcatgtttggtttggaaagacttttcctatgcatagacatgcacacacttcttttttgtagttagtgaaatcatactatacatacatgtttgcctttgattggtttgcttattaatagaccaataaatatgtctacttcatcattctttttaatgtctgtaaaatacatagtatggatatttctcctttttaaaagtgttagattatacttcaatttttaaaagcattaaaatatgttagcttgtatagatacyactagaaaataaaaagttagatgaactttttctcttgggtgaatttttagacagtgtaagatagatgacagaccacactgacaagtagttcaagaatctgatttttgtggagaattttttttaactattatatttgaggtgttcagtgaaaagttattttcctttccataccttccccccatctcttagtttccttctgcagaggcaaccagtgttacctgcaagtttcttctgcatccttccagagatacgccaggcatacgcatgtgcatgtgcaaatataatccctcctttttgcttattaaaagttattttgcacaagggacccatgagtctaatggcaatgggacactttaagcctcactatccagatcagcctctgctcttcattgttgtggggttttttttwaattgttattaaaagtacattttggagagcaaactaagtcagatttggggggatttttatcactcaacattttgttgtgaaatgccctacatatagggaagttgaaacaatattataccaaccatcctctaccagatggaaaaattgcaaacgttttgccatttttgcttcttctttctctttctctgccattatgacatttcacctgtacaaaattcagcatgcatctcctaagaataaggatatttttctacataaccacaatagtaagaatcttaaacatacttccagaatatccaatctatattcaaatttccacagttgtcccccaaaacatgtcttttacagattttacttccagaccaagttcaaatccacatttatggcctacatttggtgtcttagtttcttttcatctaatcagtcaccacacatttgttgttatgtttatttagaaataagttgttagactctgtgtatatgttttgtgttagtagaaaatgataatagttgtagtaggatgcatcggagtaaaaaggaaaaggctgatcagggccagaggtcaatgactgacctgggggttctgggaacctcaggcccaaagtagttataatgggacttaggagatcattatctcagctcacctgtaacctatactttggcatattgattgaaaggctctgggttattaaaaaaaaaaggtgacagagttaaaaataacagtaacagtgacaagcaagatagaaatatatttctctttcatgcagcacagctctgctccacaaagccttcaaggctgattgataggtgytctgtggtataagagactaagtctctagggtattatcattatccaggtggtccgggatgactcaccacccccagattttagtcagtcggaagtggggagatggtataccctgcaagttgctcagtacctccatgcatgtctgactggccagaacttaatctaagcttcaagggaggttgggaagtgtagtcttcattctggggagccatataccagctaaaagtcccagtatcttagaaggggaccagtatggggaccatgaatactttctgtgacagacttaatactttattaataccacttataaccagataatactttactatttataaaacatttgctttgcaagccaggtctacactgccttcataaaaagtatttctaatactataaaactttgttcataaatcattttgcttttgaattaactaagcaaaccaaactaagaaaccaaatttgattcttttgacaacattaatcatgaatgttcagtaactttacaaccctccacttggayaggggaattaytagaaacaaattattattgtaactctacagcattttagactttgccttacaaaatactttcagggatgtttaaaagtgtatagctgccagtttatttaaaaacgactagaataataggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttgggaggccaaggtgggtggatcacttgaggtcaagagttcgagactaacctggctaacatggtgaaatcctgctctactaaaaacacgaatattagtcgagtgtgggggcatgaasctgtattcccagctactcaggggactgaggcacgagaatcacttgaacccaggaggaagaggtttcagtgagcctagtttgcaccactgcactccagcctgggcaacagagtgagatactgtttcaaaaaaaaaaaaaatctcatttacgttttttctgaagcgcgtcctcttgtgttacatggcaagtcaggcatcggcaccgtgcgtattttgcagygtatatgctctacgtgsggagctttgtaaaagtgttttctgttctggtacttctgttaacagcatcacagccacagctgccagtattggggcagctggaattcctcaggcgggcctggtcactatggtcattgtgctgacatctgtcggcctgcccactgacgacatcacgctcatcatcgcggtggactggttcctgtgagtatgcttggcctgcattccagctcactgtcacagggtccccctctgtcactctagggcaccaggcagcctggcacatctacagaaagaactctgaggagaggggcctctcggcccatagttaaattgtccttattgtctgacccctggtccttatctggagaccgagccccagatgccatgtgcactcactcccctgtcagcctaaggggcacatctggctgccacacatctcactccataaagccattcaggaattgggaaacccgctgtctgcaaaggcaacataaatcagcaaggctgtttctgagttgcacaacatgacaccacagcagctggaacaaagctgcaggccccacatgccagcttaggccctgcctctgtgtgcttcccattccagtgggaatgattttcccatcctagcccaatagggtgaggctgagctaygccgacactgggaagagagctagtgtcattaagtggaattgagtttcrgatctagggaaagttacaagaaatgtgccctccacattctcaaactctaacctctacaggcccatcccttcgcccccttccctcgctcttccagctggcattctctgtgccttttctcttaaaaatttccttccacttttgaaaatctttccccaggatgcccaaagcaaagcctagaacagagtacgtgttggagttaacacaacatatgttcactagaactgcaacatgaaaagagcttgacagtgtgcgtgaaaccccagactgggcgagaggattcactccccagttacttggacctgtgtttgtgtcctgaccttgtgtgagaccgggcagattacccaaccaccctagtttctacctctgtaaaatgagggtgcccgtgtcctctacctcctaggggtactgcaagattcagtgcaatgatgcctagaaagcatgcagcctactgtctggcccacagtcagcatcagttaacatgagcactctcatataaagctacagttctccacagtctttgatctttacacttcaaaattattgagaactgaaacagcatttgatctatatgggttgtatctattcatatttatcatattagacacacttataaatttccacttgttaatttattacatgttttatttaaaggtgataataattcataaaataaawtaatggaatgaatttattatcatctttaaacaaaaaggttatatatgctaacataaatagcatttttttgcaaaaaacaaccatttcgaccccaaaatttattttatttatttacttgttttgagatggagttccattcctgttgcccaggctagagtgcaatggcacagtcttggctcactgcaacctccgcctcctgggttcaagtgattctcctgcctcagcctcctgagtagctgggattagaggcgcccgccaccacgcctggctaatttttgtatttttagtagagacgggtttcaccatgttggccaggctggtctcgaactcctgacctcaggtgaaccacctgccttggcctcccaaagtgctgagattacaggtgtgagccacggtgcccggcctcgaccccaatatttagtgaaaagaatggtactattttatgttttgcaagttttcttaatgtctggcttaatacaagacagttggagtttcctgtttctgcagtttcacaactgcttcagkgagttgtgacatcacacatcatgtagtctttgcaaaactccactatacattcatgagaaaatgagactgagagggacaaatgacatcttagtattattatgagaatggcttaaagagaaggctcgttccccactgttgggwctctcacttcagtcaaactaataactgaacattcatcatctatatggccttataacctttaatagctactattatgaatattatgtgtctattacgtaatcttgcagttggtagatacggcgaactgaatgttaagaggtgcttcgctggccagttcctaacgtaagttgaaaacttgtgatgctcacgggagcctcgtttttccctcctccccaccctgcctgcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccargtgttaaaaaccattataaaatctttccatctcattacagctcattcgctccagcaagcccgtcatcttccctttcctcccttctgataagactggaaartagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgattttttwatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctytctcttctgactggtatacctatttcattagtagctaggtgcacatmtacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcraaaacagatgagaagactagcagctagcaagggtgcttgtrgtcacactgtggaacactaaagagctaggaaagagttgagcacaggcaacattacaaayaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccrcttatcaaatcattcaaaactttcagctggagtggggtttgcttttgttttgtttgtgtccataagagaaatggtagaagatgaatcagtatgaagacactgtyaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatrtagaccccaagcattctgtrcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaacatctttgcacgttgttgttattcttctcctcaaagaaaaatacattttccattcatggaaatattacaataagctcagggcagtctctggaaggatcccatgcagcaaggtaaaatcttggcagagccagccacaagaaaataagtaaggacatgctctcctgctcaactccaagaactggagctggaaacaggaggaggtgagcggagcactttgctgtagcaggccatacttccttgtccatgtcagattcaaatttctcagatgaattgaatcatttccatgtcgggattagaaaagtgtgataccaccatgggcccttccgaaaaagtaacttcctgtctgacctccaaattaggtagatttatctctgtgattattaccaccatttgtgaaaagagctaactaagatctcaagggatttccagaaacagccattgtgctggtgctctattcattaagaacagcttacggatgactacttttcatcatgctttttagtaaagaattcgcaggcaatatcatgaaatctccagattgaagtagtgtctggagcctataatctgaccctctctaccagcaggtggcagccacctagaggaaaggctcttaagttggatccatggacccctaggtcatccacatgagagttcaataggttcatcgcccttgaagttgtggggaaagttttgtgcatttgcctttttctgggggtaaaattcttaatttcaatcggtttctctmacagatcttacgactaaaaaaaaaaaaaaatttacaaatcgctatgtttgaaccatacaccctaacttttgtgaaggcatatgtggtatttacatgaccagtttgggaaaagaaaggctgctcacaaactgagggaaccaagcctggccaccctgagcagatcaatatttgccccctgtgaracgttctgggaagtgccgcataaaatcaatccactgctaggaagtgctcccttctgccgggaccattttcttcccttctgcagcccacgctgggttttggccacctccacaatgcagacataagaagcaggtcatctgcctgtgggaggtctgtggaaagccccttatggttaagggaagtgcctctcagccagagtatgacaaagagggtggagaagcaggccttagatcccaacatgtggtagtcacacatgtgctcacaaatggaactatgaaaaatatgcaggttcacagcttttttttttttttttaagatacagggtctcactctgtgattatggctcactgcagcctcgaactcctgggctcaagcgatcctcagcctcccgagtatctaggaccataggctcacaccaccacgcccaggctaatttttatttttattttttgtagagacaggatctcgctatgttgctcaggctggtctcaaactcctggcctcaagccatccttctgcctcagcctcccaaagtgctgggattacaggagtgagccgctgcacccagcctctggctgacattttttaaaatgtttcttataagttattacatttaacaaaatatttaaatcctaccctcagaagttaggagtctatgtcctcctgtatccacattcatcctggtaccaccactgtcccttcccacccaagcaaaattctccttttcaagagaaaaaatctcactttacctcactatacctataagtaaaggcatagaaaaaaaagtaaaatccttgactcatctacacagtgttgaaaacagaagtgtgagttctgttagctgaacgggcctggaggaagcgtggcgggaaggctggatccccgccgcaggggctgcggggctgtggctgcctgcgggctgggcagggccgggcgcacgccctccttccgggtggccgcgggccccgaccccaggctgccgtcagtcgagcggcctccgcagcggccgcgcttccccttctcccacccgggtggtcccagaactggagcaacaatggccggctctgtgtggccgcgtcctggggccaaagcagtcgggacgtgtcacgccgagggagggctccgaatgaatacgctgacaataagaaggaagggagagcgagggaggtgatgggcagcgtcctagagggaaagcgggagatgagaaatctacgagatccgcgaggcggcgtccggggagcgagcctcatagtggccaccagggggaatgcggagctcaccttgggccgcttccgcggggagctctaaagggagctggggcacttcctcttagagatctcacttgggtaacatcgaattccaagtctgcagtgccgagagggagcaatctgtgaaagccatcaagtcaggtttaaaattcctcagtgcccccatgtcacttttccctctgttcaccctgcttcttcaatagcctccccagaggacccccttcctttctgggtatcctgttttgtctcccttgtgcctcatctcccttctctcccatctcctcttccggattctcatctccctcttctgtcacttacatgttttgcagctacagacaggtactcagaaggtggcatggtaacgktttcctgcaggtcatgtctcatcgtgcccacaaaactgctgtctcaaccttcaattttgaaacattcacagcatgctgaattccacatataagtagggttgtcagataaaatacaagacacacagttaaatttgaatttcgggtaaataacaatgttttagtatgagtattaaataacaatgtggtggtgtaagtatgcaaaatactgcatggggcatcctgtaattttatgtgttaatctggcaaccctctagacacttgaaatgtggaactcagaacaatttgtatttgcttcaatgaagctgatattataggtgaaagaggttgcttggagtggggggatcttcattataaaataatcacccccattttgaatttttctctgaaagcaaaaacatgctttaaaaagcaatttagatctaacatctcctactattaattgttctggtgacattatcacttattatgtgcttgtaaatcttgtggccatagttaaaaagcttgatgaatcacctttaggatttcacaaaactgtcttgaataaattaagcaatacctcagttatccatagttgagatatttaagactgacatctgcttttgttttcttccctctcctattttcttctttccttctctcactccttacttctaccctccccactgccccaacataaaatattttctgtaatccattacagggctgaaaattttggcattcacatattgttctccaaagacggacacatttttttcatttggggagcacctattagaaaagcacccattttttttcatattgtgctattcaaagttgattattttccagtctctgtaaagttgagaatgaggcatttttcagtctcttcagggaactccagcctccatgaatgggaatcattcccaaaaaaaacccctttttaagccaagtctgaaggatatgaaaaaacaggacccaactgacaccgcacaaggggaacaaaatcaaatcataaactctttccaataatgacatatgcaaaatcatgtaaagatggtagtgagtgtcctagaagatggtgtcagatgacaacttttttatttcttttccaactcttagcttcagaggatcataagtcctggaagcagccagccaggagcttccagacatagctgtcacaggggaaaataaagaccatttggaagtcagctcagccctgcacaatgaactgatgactggcctgccctggggagaactcagcacgcaaagatttttgtcggcaacacaaacctctgaatgctataaccaaattcccctgcccttggcactccagtgcctcagtgaggccttctttcatttaagcccatgaggagctgttagctaaagaagtggaaaacaaacatgagaaagtcagcaggcatgttagaaaactcacatggctagactaaaaatagctttacgcttcctaaaacttaaaggccttccgcttcagagtggtggttgaactcaaacttctacacggggatgggttgaatccacacttgttatacctgaattcttaagcagttcagagaccctggctggtccattccctgcacctcagcatcctcatctgtagatgtggggattgcatgaaacctaccgtctccaaatcaactttcatatcaagtgtctgtgtattggaggggatgctagagttaaaacgcttagttaaatggtcaactgcccttagcatatgataggttaaacttcaacttccctatcgtaaatgggtatcataataccttctttattatggtgtaatgagaattaaatagataataactagatataagattctcagcacagttcctggcactcagggagattcttaagatgttcagaacaacactggctcagtagggaggaagaggcacggggtgacgctggaggaagggagagtggctcccggtgccatctggacctgctgtgagctggaaggaactccccgaggaggccacagacctacattgcccgggggggacgctttgcggaggtcgtcacccctggaaaccggcatcatgagacactgccaggcttcttcacggaggggcccgggcctctgcgcccggggcggcccagcaacccctgctcgcctccgcagaggccttttgtcccgcgggctctcccagcggccccgcgctgcgtggccgttttgtgaagggcacaatccgatgttctgaggagaccacccagcttcctctcccagagtctaccagagaacaaaaccgccccttcgtgtgccagcgacctccccttctgccagaccccctcccactggcctcctccctgccctgccaagcggggacggagagccagccggccctggcccggtgggaacccagttgatggtgcgcttattagctgtcctgagcgcggggacaaactttctgtacctgggccgctgctgccaccctgcggccaagacctttctctaggccccgatgacccagagcagcccggaccagacaacgtgcaaagaggagcgcttacagcaaactcctccctgaggggctcaaggaaggctggagagccaggaaacagttccgatggctgaaggaaaaaggaactcatgctctgtggccacagcactgattctcaaagtgtggtcccacaaccagtatcagcattccctgggaacttagaaatacaaattctcagacaccaccctagacctactgaatcataaactcagagggtagaccccagcaatctgttttttggtttgggggagttttttagagatggatcttgctgtgctgccctggctgaagtgcagtagttattcgcgggcacaatcatagcgcactgcagcctggaagtcctggggctcaagtgatcgtcctgctaaagcctcccaagtagctgggactacaggtgcatgccaccttgccctgcccagccatctgtcttaagaagctgaccaggggattctgatgcacacccaagtttgagaaccactggtctagactctaaaaagaaacagacctcagaggtgacagagcaggatgctaatcctggctttgcctatgagctgtgtgaccttgggcaagtttcttaacctctccttgcctcctctgattcctatcatgatgaaaatcattcctaatttccaggattgttgaggattagatcagaaagaaaggtgaagtcactgacatatattcgtgcttgataaaaggtgcttgcttccggtgttattataatggggtcataaatgtgcccgcattaacactagaatgtacagagaaaacacaattcctcttttcatttatttagcaggtatttatgggatgcctactgtaatgggcaatgttgataaagcccctccctccagggaggtacattttaatatctgtgtaatatagggtgctatggactgaattgtgttctcccacccttcaccaacattcatatgtcaaagccct

SEQ ID NO: 12378 - DNA, 234309 bp, Homo sapiens
  misc_feature (1)...(234309): n = A,T,C or G, or insertion/deletion polymorphism (see Tables 1-2)
ttcatttagaagtttggtgatgtttttgtgaccagcaatatgccctaggaacttaactcttgtgtacatccagtagcctatggtaaaattggttttgctctacattgtttcacttaaagtcacagtttccaagaactcacagatgacattgaggacttatctatgtgcatagatatgatggacatcctgacatttagtggatctcctttaaaaaactgaacttaaaagtctcttcacgggcaggtcaatttcactggttgaaagtaagagacaggggaaccctcgtggagccattcatacagtccctatttaaggaacaagtgattatgctacctttgcacggttagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggaagtaagctacataaaccatatggggtgtctttggggtttggttggttcggggtatggggctagcagcggtgtatatgttgagtaaggtgggcagggagttgcattgatggggttagtagaatgggagttgagggaggatgatgtgttagttgaggggtgactgttaaaaatgcataccgccaaaagatgaaatttgaaatctggttaggctgatgttagggctctttgtttttggggtttggcagagatctcctttaaaaaactgaacttaaaagtcttaccaaaattcatacttatcactcattacctaaatctaactatttttccctttggcattatccaatttatatccaatatttagttttaatcatttgcaattgtgtatgacatagtaaagattctggggaggccaagatgggcagatcacgaggtcaggagatcgagaccatcctggctaacacggtgaaaccccgtctctactaaaaatacaaaaaattagccaggtgtggtggcaggcgtctgtagtcccagctactcaggaggctgaggcagaagaatggtgtgaacccgggaggcggagcttgcagtgagcggagatcgcgccactgcactccagcctgggcgacagagcaagactccctcttaaaaaaaaaaaaaaaaaaagattctgagtcaaagtgctcaagttgaatgcattttgtcayccacaagacaaaacgtgttaaccccttgtggtttactttatctataaaatagagataacaatagttcctgcttctagggttgttgtgggaattaaagacttagaataatgttcagcctctaatcagtgctgtcacaactgtctgatacaattgtattatatttgtgtactttgtagattgatattaaatcatacttttaaaaataggtgcttaatgttccactcaattaccttaaaacatgtttaattatgtctctatcctactcttataacacttctataaaaactttttacatatagcgtccacttttggttcagtttcttaggaaaataactttgagagtcagctatctgaaccaaagaaacattaacattaccagactatattgggatttttgagactggcttttatcaattctttagctacgggctcttgtcatcatctctaccagtgacctaagtgtcaaacccaaatgccttgtatctgtcccattaaagagatgcagcatctgctcctttcttactgtttccatttcctctgccatgcctcctcttacaaccataaatatccaggtctcttaggttttaaacggggcatctctcaacccccacattcttttccttggttattcccttccctccaacagttcaattcacctagatccccacgcctgaaattatcctagatgtcctagaggcgcctcatcattacaatggtacattattctccactcctttacatgtcacgccagctttcaaactgaaaatctgagcgttcatccctggtgcatcacctttaaattcgagatctccaaaatccagggtcatgtaaccttaaaaaatttttaccctctcttctccactgcccttgttcaggccttatctcttccagcagctgttccaaaggcctactctgttttcctttcggagtgctcacctccaccgaagcctccacccagytgccaattctgccccatgcctgataatttgctcgtgcgttgacatacataaaatttctaagacaaaaattttttaataatggtaaatgaaccttgggaactgcatacagatcatacagatccataataagagaaaaggtcccagattaacacggaaaactttccatttaactaacatttgcactggtaaacttcatcaagcaagaccctacttaatcccacattaccttctactgaagaggttgtggtcattctctggaaatatctgaattcattcctacaagttagagaaacagcgttactcgaaacattatcccttgggctcgagctctaaggcacctgacaaacggagcgctgtgggtaggggtgaggtgttttctccagggctgggactttgccctgggcgagggcgccgcagggcaaagacctcaccgggcagcagaatccgggcagaaatcagcaactgggcctcccgcgcagcagaaaaggggaatccagtcgggcccacccttcctgccagcgcagaccgcaagtctggccccatcctctcgccgggagtcggcctggcgcgtcccgcccaggtaccccgaccgtgggcagcctgcgcccgtttgggtcccatcgccccggcccggcagatacctgagcggtggccagggcaggtccccgttcttgccgatgcccatgttctgggacacagcgacgatgcagtttagcgaaccaaccatgacagcagcgggaggacctccgagcccgctcgttacagcagaacgcgcggtcaagtttggcgcgaaattgtggccgccccgccccctcgtccctatttgtgcaggcgaggccccgcccccccgccccggcgcacgcagggtcgcggcgtgctcgcgcccgcagacgcctgggaactgcggccgcgggytcgcgctcctcgccgggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggcygcagcgsccscagcgsccgccttcccgccccagctgccgccgcacrtagtaggttctgtctgggactgggcagggccatcggggctgggggggcggggcttgtgggtaaggcgggcggaggcgkggaccctccgcccgatgatagggctggaggaggaaggggcgggctgaagaaggggaaggtgggaagagcccagccggggctacaaattgggtgaagcgctgaggttttagtacttccgtttgaggagataggcaaaggttatgcaggtttttaatggcaggcctgagacaggaactcaggtctcctgactcccattctgatgagggggcttgtgggcaaggggtgcgtcttttaacctccatcctttttttttttccttggtggtcgaagagtyttactgattttttaaaaaagtgctggattgggtgactagaagaaagctgcccttaggtctccagtttttaagactgcaacagcatggctcaatatttgaaatcactacggttaaaagcagtcatattgtgcagttccccagtgaacwctttttgtagtttagattataaagtctgaaatacagtttgggtggataaagtttcttaggatggtatagatgtgactaatcatggagtccttcctgttgccrtccttcaacgcaataagtacgtttgtttgtttttaaaccagagatactgccacaggaaaagcccaagggtgacccctcacttgggtcacctgcacagtatttttcagaytgagkctgtggaagggcattgaagactggtgtttagccacctaccgtgttttaatgtaggtggcagcttgggtgcttcaaaatcttgttcctttcgtatatatttctcccttaaaatgattactcctcttctgttttttttgaggacgagctacgttttcatgaattcaccaaaattttgcacccaccatttaaagggtagctggtgaaggacttatgtatgcttttggcaagttttctgccaagaaaaaattcataatcttgtcacatctttagtgatgaacataaaccttttaaacaggaaacacttaaattgcartgaacatgtcaaaaatgatactgttcttttattacctatcttttcccctctgtgcctttgctacataactgtttatttcttagaggtattttatttagcatatgtaagtagggtgattcaagttttataattagagaaagctgaaggctcattgaatcaagaccggtagcagccttggtttcaattaattctaaacacggcttgagttgctgaggctcctgactrtcagactctaccttgtcttttatggtgttaaaaacagttcacccatagggttttccagagctaaaagtagaggattctttgaagagtggatggcaaggaaccttgtcattcagttgtaargtttaaattgsttcacatacgtcaggccttctcagagtagagataacacatcattttctaaccttcccgatataggctacagaaattgacagaagaaagaagagaccattggaaaatgatgggcctgttaaaaagaaagtaaagaaagtccaacaaaaggaaggaggaagtgatctgggaatgtctggcaactctggtgagttgtgggggattcttttttctcctcagtcatggcyctggtattctggaattctccagagggcagaagagcstattagaattgtgtcttttttctttgtggagaaaggtcccttttgttcctgagcagagtggccccctataggtgatggtgatgtgtataggaggttaaggggatggtagagctasaattctgcaatttagctgtagttctcccaactttctcctttattccttctagctatttttgtcctggttataaaattaaaacattcttgctacagaaatttcaaacagtacagaaatgtggaaggtaggcagtgatagaccccataatccctccctttgagtgaggcccactgctattggtgttctgtatatacttccagattttaaaaatttgtacatgtgtatatgtgcatagtcataagctcaaaaattagtttaaatatattttacagattatattatattytatactaatttgctactatctttttctactattaatagaatttagaaaattttgaacaattttcagtatcaggacctgcagatctactctccccgcttttttttgcttagagctgctctttgtgtatgtaaaaggcattgaataaaaacagcatgcctaggctgggcgcaggggctcacacctgtaatctcagcactttgggaggccaaggcaggtggatcacctgaggtcaggagtttaagaccagcctggccaacatggtgaaatcccatctccactaaaaatacaaaaattagttgggcgtgctggtagttgcctgtaatcccagctacttgggaggttgaggcaggagaatcacttgagcccaggaggcggaggttgcagtgagccaagattgtgccactgcactccaccctgggcaacaaagcgagactctgtctcaaaacaaaaaacaaacaaaaaacagcacaaaaataaataaaaacccagcctgcctgagtgcctgagttcctggatttctagaggtggtgttgcatatagacagttgagcagatttttctctagttttatggtaycagagaatttgtgataagggaagacaggaaatccatctttattcattatcctcaggaaattaggtaaagagaatgagaaaaaaaaaaagtyccaattcagatagaggtatctgtccaatggagatatatgtaaaatattaatccttccataaaaggtaaaatttgaattttagggtcaacatgaaagygttagtatgaaataactacaggaatggagatgtgtggctaaggagaaaagtaaatctaaaacttcacctttctggaggggtcatgcaaggaggcgtgacttgagagaatttgccacggttaatgttacaattctggggcagcctacctttcattgcttgattattctgcatagacccattttttaggtctacaarcactgaatgagcacctmtgatttttattctagaggctttttgtagctcatttatttttcctaagaatgctttttgccccttttytttttttttttttgagatagggtctctcgctctgtcacccaggctggagtgcacttgtgcaatctcagctcactgtaacctcctgggttcaatctctgctcactgtaacctcctgggttcaagcaattctcctgcctcagcctcccgaatagctgggattacaggtgcgtgccaccacacctggctaatttttgtatttttagtagagtcagagttttgcatgttggctaggctggtcttgaactcctggcctcaagtgatctgcccgccttggcctcccaaagtgctgggattacaggcgtgagccactgcacccggcctgttgttctctttttatagaggaagaagtgggtgatagatgaagagaattgatgattatcacagttaagtaacttaactaagaccacatggggacagttgagatggaatgttgttgaaataagacaacacacttggcatattttaaaataggacctttgccacttgttaaaaatggcactaaggaagaagggggaggatcattcactagtcagaagctgggtgactgttccacttcagtttattttattttttagagacaggtcttactctgtcatccaggctggagtgtagtggcagggtcattgctcatgtagcctcaaactcctgggctcaagccatcctcctgccttagcttcctagtagcaaggaccacaggtgcatgccaccatgcctggctaattaaaaatatatatatttttttagagacagggttttgctgtgttgaccagattggtcttgaattcctggtcccaagccatcctcctgcctcagcccttcagtagctgggactgtgctcctgagccatcatacctggcaagttttttgtttttgtttttttctaataacagaattattaagatatagttcttggggccaggcacggtggctcacgcctgtaatcccagcactttgggaggccaaggcaggtgtatcacctgaggtcaggagttcgagaccagcctggcccacatggtgaaaccctgtctctgctaaaaatacaaaaattagccggatgtggtggcgggcgccagtggtcccagctactcaggaggctgaggcgggagaatcccttgagtctggaaggtggaggttgtagtgagccgagatcgtgccactgcactccaagctgggtgacrgagtgagattctgtctcaaaaaaaaaaaaaaagatacagttatrcaatatgattcacccatttagcatgcacaattcggtggcttttaggatattcccagagttgtgcaaccatcatcaaagtcaattttagaacattttcatcaccccaaaagaaaccctgtgcccattaacagccacctcctgttctgccccagcactccccagccctaggtaaccactaatctactttctgtgtatagatttgcctattctgaacatttcatataaatggaatcatacaatatgtggcctttggtgtctggtttcttgcagttactgtaatgttttcaaggctcatccgtgttgtagcatgtatcagtacttcattcccttttctaaaaatattcattttctttattgtggtaaaatatacataacataaaatttatcatcctagacatttttaagtatacagcccaggggtatttagtacatttatattgttatgcacccaccaccaccatccatctccagaactcattttatcttgcattcctataactctgtacccattaaacactgactcactgtaacccccttcccccagcccctggcgcctaccattcagctttctgtctctatcattttggctactctataatgcattcattcctttttatttccaggcagtattccattgtatatatccacctcagttcttaactcttcaattaacaagttattttttatacctgggatccacgggggaaggaaacttttatactcacaagcaaacttagatacatttgaaaagccagttaagtacgtatttttgaaaaccaagggaataataataaagtaagagatgcatagtccattttcacactgctgataaagacataccagakactgggaagaaaaagaggtttaattggacttacagttccacatggctggggaggcctcagaaacatkgtgggagktgaaaggcacttcttttttttttttttcttaatttaagttctgggatacatgtgtagaacatgcaggtttgttgaaaggcacttcttacatggcggtggcaagagaaaatgaggaagaaggaaaggtggraacccctgataaacccatcagatttcatgagacttattcactatcatgggamtagcaygggaaagactggctcccatgattcctcccactgggtcctcccactgggttacctctcactgggtccctaccacaacacgtgggaattctgggagataaaattcaagttgatatttgggtcggggcacagtcaaactatatcacattggaaaagattcaaaaatatatttttagcataaaggaagtcatggtaaacaaggtaactgtataytggaaaagtcatatttagaagaaaagagtcactgtatttcttcggagattcttagcctttagcatataagacatcaaaggttttttatttttaattatagagggttgtctttttctctggttgcttttaagattttctcttaatcactgattttcatgtttgattttctttctgccccatataatctgcaggaacmcatatttgattttggtggaccttgtctctttcccccacacccgagacagcctgtgctgtctagcacaggctggagtgcagtggcacaatctcagctgactgcaacctctgccccgccaagtttaagcaattctcctgcctcagcctctggagtagctgggattacaggcactcgccaccacgcctggttaatttttgtatttttartagagatggggtttcaccatgttggccakgttggtcttgaactcctgacctcgtgatctacccgcctcggcctcccaaagtgctaggattacaggcatgagccaccgtgcccagctgcctttgtctggtttttaatttttatttcttcatttatttttatcctgtttagagctcatttaaagcttctcgagtctgtgggtttataggtcttattaaatgtgggaaacttttttggttgttattgtttcacattttttctgtcttcctgtctcttgtgtctccttctgagagtttattacrgggatgttaactayttgrtgttatckgttaagtcattgaggctctttycatttgttttccaggcttatttctctttgtacttcattgtggatagattctactgctctgttttcaagttcagtggtctttttttctgctatgtctaatctgctgtaaatctcgtttaataaaatgttcgttttccatattgtatgtttcatctccagaagttccattttgttcttttaaaatattttccagttctctatatgaattatatctcagtaaagctaaaaaaaattccttttgctccyttttgctcatgttttcctttacattcttaattatatggagcatatttataaattgtattttcttgttcttatatgctaattgcatcatmtctgtcatttctggggctgcatcccttgacagatttttcctattttttgcatgtctagtaactaattatttggatcatggatatgttgaatctgtgttgtctcctgctggagtttgtatttctttagagtgttggactctgttctggcaagcaattaaattcctttggatcactttggtctttttaaggattgtttttaaacttcggtagagaataatagcccttactctagagcaactttagtcacattctayggcttgacctttttagagttagaaaggggtgcatagtagcagtagcacaccattatatcgtatttccacaatacagagacagtagacattagtaacattaagaatgtaaacacagccatatgctacctaatgacagtcagtgagggaccacctatacaacattaatctcataagattataataggtatttttrctgtaccatttctatgtttaaatatgtttagatacacagatacttaccattgtgttacagttgtctctagtattcagtacagtaacatgctatacaggtttataaccygggagcaataaactataccatatagcctaggtgtgtaggaggctataccatcatctaggtttgtgtaagtacactctctgatgtgcacacaatgatgaaatcacctaatgacacattcttcataacatatccccatcattaaatgatgcaagactgtcaacacctgtagtaagttttaggcagtgagtaagtatttattattcatctagtagcatctgccagmcataagagtccctgattatttcatctctgtttttaacactttggttttaaatactgtcaaagtcaaataaaatatagagacaaatctctaaaacattttatttggggyggggcacggtggctcacgcctttaatcacagcactttgggaggcggaggcaggcggatcacctgagtgcaggagttcgagaccagcctggccaacatgatgaaaccccgtctctactaaaaatacaaaaattagccagatatggtggcacacacctgtaatcccagctattcaggaggctgaagtaggagaattacttgaatccaggaggcagaggttgcagtgagccaagatcgcgccattgcactccagcctgggtgacagagtgagactctgtctcaaaaaaaaaaaaaaaattttttatttgggaagcaagaattgcaatttgggacatacacrcagaccaggtsgtctttggtatgtttgaagcacaaagagaaaattggaggttttattaaaaaggagaaataagccaggagcagtggctcacatctgtattcctaacgctttgagaggccaaagcaggaagattatttgagcccaggagtcagagaccagcctaggcaacatagggagaccctgtctatacaaaaaattaaaaaaaaattagttggccatggtggcacttgcctgtagttccagctactcaggaggctgaggtgggaggatctcttgagcctgggaggtcaaggttggaaaaagaaaatgtatygttttgaacgaaggttcattggtacttggaaaatttggagtaactggcaagctctgattagtgaatgactgcaatgggtaaaactagccwtagagtcacagcaggttgttttagcagctatcaggtaaaattggtttcaggttacagtaggcagtttcagcagctaggcttgcagagaattacatttttggagcaatgatatgtgctctcagtgctttttcccctggcctctctactccrtttcaattgagtatgacaagaatgacccaatttatatgatcaactttcacaatactttttttttttttcccagcaaatacaactccaagatcttcatcccactttcattccaggcagtttttttttatgtctataggagggaaamtctttgtataacatacacacttatagtatatttttgaagagcgatacaaatatacatttcaaaaaagagagtaatagtaaacaaggtgaatatacatttgagaaaagagtcaaatttaaatttttrtggctagaaaattcacaggagatctaatgaaagcctgtgaagaggtttaaatataaatagggaaaattttaaactattttttttgaagcaacaaaagcagagatttattggaaacaaaaagtacactccacagggtgggagtgggccctagcaagcagyttgggagcaattttaaacttttagaaatgaacaaaacacaactcttgccykcagagtgtttttgctttaatagggaaggtaagaggtgataaatgtgtgcagtcccagttcctttacatttaatagcaccaacctaatagtagtgctctaaacggtgaaatactgtgttctagtacatggtagggatccagaaaatgatagtttcccttcttttatggattgcttgtttatgaaaaactgccaattggcagactgtgatgagtgccacagggagatgtgatcttgttagaggaacacagagaaagaaaagatgattttaagctgtgaaaattagcagaaggttttatgggaaaggtagatttgagatgggtcttgaagaatgaatacaattttgacatgcagaaagcatatcatgggcaaagtgatggtgtttctgagtatggtgatttggttttcttggtaaacccctgatgtcaatatcaagtctttccgcttgagctagtaagatttcccagtcaagagtcctcccagcttctgcctggaggggagtaggagtgctctggcttcctgggttctggagaggcygtggatctcagcatacattgtgtctgtgttcctaatcgtccttctgggttaggtacagtactccatcaactgtgcttgttttgcctttccagggaagaaatctccagttggctgctgatgtggaggaaggacagttgtctttgagcttggagtatggtaggggtttagggaacaaattgytttgaaccaatcctctttattttagaacctccctttattcctttccagagctactggtactctaattcctgagtcttttgagcattttgtgttgtaattagagttggctcttggttttcctaattactgacttagtatttagctctcaggtgtgctgaattggttactgttcatttgttttcctttctagctttagatatctcatttgcagttgttacctctcctctctgtccttatgggcttatgtcttcaaaaaaaaacaaaaacaaaaaagaaaaaaaacctctactatagtaatgaggtttcaggaatgagtgaaattgcatctgtgtttaatatgccatctttaccctgaacccagtgtttctttctttttttaaaaaaatcacattatagttagrttcattgctttattgggaatctacctctttaaaaaattctatgctggttatgaattgacataatgagaccaaaattactattgttctgttttcttcttatttgctrcctaagagccaaagaaatgtctgaggacyaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggtatgtaactgctatagatgagtatccagttacctagaatagtgggttctgaagtactrtcaggttctctgaggtcattcatggcaatggttcctaaacttggatggtcttctgaatcatctgagggagmttttgtgttttagtttagttttcttacatccctggagattcgatttactrtgttttgggagggattaattggtttgtatgggaacaaaacaaaagccttccaggtaattctgaggtatttcctggatcaggagcccttgacttggagggattctttattgagaattaatacaagcacagtttcttacagtcttccttagagtttccatgattaccgtggaaaatcatgatgggcaacttagatattttgaggtttcagttgaaagcttgatagatagaaagtaaattcaaatgtaagccaaatgaacatgggctttttactttatccactatttgttttgagacttttaatggttttcataactgcagaatcagggaatttaactcatgctccatcattgaaatctgtaattcagaatagtgattggttygcaaccttagctttacattggaatcacctggagaacttmaaacaaaaattgccattaagaaccttccctcagaatcttatctaattggttttcactgasaaatgggcatggatattttttaaaagtttacattttattttgtattttatttttattgatggagtcttgctctgttgtccaggctagagtacagttgtgcgattatagttcacwgtagtctcaaacttctggtctcaagcaatcctcccaccttagcctgcagatgaggtgagactaaaggaaaagcagtcattttaatctgtagctgtgattgacaaccattgaattagagaaatggttctatatatgtatatgtatgtgtgtatgtatatatatgagtcattgaaattctaatgaaagctgttggcctttttcttcagaaaaatkctcaagccaacaaaattttgcctataattttcaagatttcacacctttcccacaaagyccagatccatgaactcctccctcagccaggctaatattgattgacttatcttagatcatcaagaaaaaaaaggtgtttttgtttttagtctcttttaatacttagaagcagttcacstaagtatagtggttattaagcatagaagtcataaagtttatccattaaagctcactttattgataggagcatttactccaaggtctcagaagagcrtatacattattgctttatacatagaatgaccaacttggcatgtccacatcacaggaaattagaagtaagtagacagagggggcacgtagaagcagtgccattattrcargtgataagctgtttgatggcatggatagaygtggatgaatggcaaaaagctactgagtgaacataaatgccccatggtccaggaccattagggtggggtcagcaatgccataactctcaataggtttygaaatatattctgatcactctgaattgtccagacaaggttaaattgagttcagcatactgtctctgggaatatgaaatagaatgtaatgtatctgatgagtatttctatccaaatcattttttttaaagttgcttattttgttacccaggtattaatatgtacaacaaaccctcatgacacaagtttwcctatataacaaacctgcacatgtacccctgaacttaaaatgaaagttaaaaaawagttgcttaatattcaagtatttagattgatttaattgttagcatcccataaggataaaacttttttttcctggaagcttatctcatttcctaaaagaataaartataaagtaagaataagtttttacaatgtaagaaatatattttctgtgttgattaacttttatactacatagtatatacctgcatttaatatagaatacatactatattccatgacataaaagtcatggaaacaaaataggaaactcatcaaaattaaaagcaaaggcattctyaggtataggaaaattgttatgcaatccttggggtgttgcttcgccagctgtaaacctctgtggctggtggtgcctttgcccgagtttttmcttgggcctgctggrctcattcctcccactyggcctggcaggctgtgcttggcttttgcttttggcctgaatctcrcagctgccaagggtgagccaggagtggagtggtgagggtgaggggtgtgtgagcaggtgaccatggggtctggcccctgtgcactgccaggcatgctggyttcggcagggtgggcagctccaggtgccagcgtgagtgagggctggaccaggcgtaccacaaacagcttccacrgctggcaccagggaacacagtggcgcccagaagcttggagattccaggaactgcagagccccagagagggtgtcatagacctggcttaggagcccctaggtctgagctccccaraggtccacagctcttctctcctgtcttctctccttcttgttgctgcaatgtggcaagcaagagatgggtttcaggcctgtttgtgttacagctcttttagccctgccattcggtgggtcccaggttcttgtcctgcttccaggaagaatgaagtatgtggacgagtggagggtgagcaaggcaaagaggggcttccttgagtgacagaacattgaggggagacccgcagtgggtgcttctttctgcaggcagggcatcccatcaagtgagaagtgatgagccttcagcmgagaggggaccctggagtgggtagctcctctccgcmggcaggttgtctgcttgtctcttcaagtttggccgagtctggggatttgtatgggcttgagaggaggaagtgtgtgctgattggttcatgggctgccatgggcgggctcagaaaacaccgtaagttctaattctggttcgtcagcctggcccccaggcttcaggctgttcctggcttgaaggtggggcttcacccggacctgaccctttctgctcaggagcctgtctgcctcctgccgtcatccatggcacccaggctgtttgtgccatgggrcacctgcaggacagctctgagctgccctcagccctctccttggcctccttcccatgttcatcagtgtccaaagtccagagggggccgaggcagcaggggkctggcatgttagcactgccctgagcatgtgcacacccagccaggttgcaacagttcctaggcttggcctyaactttgagatcagagtgggtgctgggagctgggagaggccaggcagtcggagcaggtacttctgagcctgcagagggagggggaattccctttctgggcccttgagattgcagagatgcccgggtccacagccacagcttgggtggctgtggctgcagctgcacccaggagggyggggctcctgcctgctcccagcccccaagagcacagggatgcccaggtttgcagccacaactgggcagccacagctgtgcccagggagcgtgaggctctcaccctgccaactcagaagggggcgaggcttcttccacccatttctggctcctgtcggttctgtggagcatgcagccctggctgcgcctctcctactgcagctggcrttacggcwgtggctgytccagatgggctgccattgccatcataatgacctggatttctcttgccaacctctccatgcctcaccgtcttcttattgctgatctttggaggtttgctggactgcactgttcaaataaattgagttttttttgaaaagttagtatctttacctgatgtcccggtgaagctgaattgttttaaacatttgggaactacaaagtrtacatgtttctgggttttcttttggattggggttcccatttctgggccattttgcttctctctcactctcscctcttctttttggtcactagatttttaggccatatttttcattgtagggggagctgggtaaatttttagaagttggcagtgacagagtggcaattaattagaagttggatttagccaactataaatttgtctcatttacatttttctaaattaagtctaataagygaggaattttccctaagctgtgaattggaattaattatggttcctcacagaaaggtaasaatagtaggagtactaatgttgaaaatgtggccttgtgctgtaaatttyttaacagctctttctcatgtttctttaccaagagaatcatggttctttctttctataagaatttatagaatgtgctgtcttttacagtgtgcttggaagtataaaacattaagtgcagctttatctgttggcatgctttgctcaaagtggttttgccctactcctgagagagagccagatttgtccccattggccttttgtgcattacacacctkagaataaataataaaaagaaaataagtgttaataataatagatttaatgaaatcaaatttaaaaacaagtatgtaaaacattaagatatttagactttcaaaatttgcataaaaattctatgatagyttacttggttcataattttttttaaccytctactttgaaaatatttgtaacctatggatagtttgcckgaatgctacaatgtgcttctataaacttttcatctagattcactaagtgttagctttttgccagatttgcattttccgtctctgggaacttattattgtggttaatatttttaaaactttatacatcttttggttgccaggacacaacactttttgatctcagtcagtttggatcatcaaatacaagtcatgaaaatttacagaaaactgcttccaaatcagctaacaaacggtccaaaagcatctatacgccrctagaattacaatacatagaaatgaarcagcagcacaaagatgcagttttgtgtgtggaatgtggatataagtatagattctttggggaagatgcagaggtaagtcgtcttttcaggcactattttatatttttcttgtctagccttaratatttttcagtatttttrtttcattttctgaccttatataaaagctgatttgatcaatcaccttttaaaaaatactgttatgtaaagtaaaaactaaaaatgaacacaagaaacttggtgggaaccagacttggtgggaaaaagtgaggggtctctattggaatgttagcgcttattctccgtggtactaggccagtactttttatccatccaaagttwattggatgagtcaattagtgaataaaccgtaatcatgtaaatatgttttctaatgaagactcaagcaagaaaacatttttgagatgtatagaagttcctctgtttactcttaatttatgaattttcatagccaggaacaaagttaagtctcaatggaagaacacgtgaactttaccagctaccaccagaagttgtttgaagttttacagatctctttgggtgtcagtcaacttggtgtcttagtctaaattgggattgtgccaggtgtggtggctcatgcctataatcccagcacttcgggaagctgaggtgggtggatcacttgaggtcaggagtttgagaccagcctggccaacatggtgaaaccgcatctctactaaaaatataaaaaaaattagcccggtgtggtggtgcatgcctttagtcccagctcctcaggaggctgaggcaggagagtcgcttgaacccgggagatggaggttgcagtgagccgagatcctgccattgcactctagcctgggcggcacagcaagactctgtctcaaaaaaaaaaaaattgggattgtatttaatgttgaaatatttattataggccctagtcaagaaggttgaaagtgaaatttgaacatttcataggcaaacttagggaaagtattgcagatgacacctttgttggaagtcatgaatgcttgtgatgattctatagtttgggacctggttggattgtacactagagagtgatgaggtagcatgtctgtgcttcytggatgggaagtaaagacttggccaactttttttcttcaagtttcctaaatcctctgtggcaggcaagcagcgttctcaaagtcagatgcattatgcwatgttctgtgatattaaattaggctctgagataatgtcaccatgttttctgagggcaggaacaaatatgtagttgtcatcccctaggcgaaggagagaaactgtctaggttaaacggtaaattcagacctgaccacggtaaaggctgatgtttttctgcccttctgtgagggactaatagagttcagagaaggggtgaggttggggagcgagagtgttagaattagagttccatggcttcagtgggcaatatctaagccatggtgctttctagaggaaatcagggaatcacatggtgcttcatggttctatatttctatcagtcgtgcatcattaattagttagccagcctggggyttctctttttactttttcaatgatttctctgtcyggatgggttcatcatttctgcatactctgtagtgtcttctaaatgtcagtcatttgcacatgccatgtagcaaattcttactcttttacagtctcatgatctctgtattggatagtctttgtgtagggaaagctctaaggatgtagaagacctgtcatatttttctgagtcttttatagatacagatgttgatactgaagttaggtcactggaactgcccaaaatacattaaaccataggcttctatacagggaacatttttttaaactttttattgacatagtacacatttagattaagtstacaaatcctaaatgtataccttgattaatttttaataaagtgaaccaacatcacatagggaatcttaaaatataaatttattgatattttcttttttcattttttagattgcagcccgagagctcaatatttattgccatttagatcacaactttatgacagcaagtatacctactcacagactgtttgttcatgtacgccgcctggtggcaaaaggatataaggtcagctttggctttaacttgtggggaaaggaaattgggattctcctccagagagtgcaaacgtgttttgtaaggtggwaggtaggcttcarttggtttagaattttgcattttacagaactgaaagtgtttcataattattagtattatrtatttatgagtttttaacatattgttagatatttagggtaaatttttaaactctatgatagtgtttcttagcaaattatccacccttgtcaactcctttaaaccctacatctgaacgttgtggactgattattttaaccatttcagaattgacgtttaaacatttygaaatgagtttttacaagtcattttttatcctttgatagcaatatttcttatttttgttgaaggtgggagttgtgaagcaaactgaaactgcagcattaaaggccattggagacaacagaagttcactcttttcccggaaattgactgccctttatacaaaatctacacttattggagaagatatcctttttggacgggagtttttctcttaaatgatacaagggctttgttggcaggttttgtttgtttgtttgtttgttttttagttgctctttgggaactttttagatgagctgagaggcattaaggtgaacccttgattaggtgtgctattcaagagggaagtagtggctggaaacaagcatcttttcacatgtcatagtagaaggcaagttcatcatacttcaagagcaagaaaaaaagcaaccctaataaaagacgatgtcaggttagtatctgatttgaaattatatcttccttagcccatttgtgggaagtagttaggtgcttagggcctacaagctcctcagggtctttccaaagtgagacctaaaaagtaacttattgaagccaggcgctgtggctcatgcctttaatcccagcactttgggagactgaagtgggcagattgcttgagcccaggagtttgagaccagcctggacaacatggcaaaaccccatctccacaaaaatacaaaaaattagctgggcatgttggcacttgcccgtagtcccagctacttgggtggctgaggtgggacaatcacgtcagcctaggaagtagaggctgcagtgagccgtgatcatgccactgcattccagcctgggtgacaggagtgagaccctgtctcaaacaaacaaacaaacaaacaaaccaaaaattcaaaatgtgaaaagagaactggctgaagtcagaattaagacagagttaaatgcctataaaatatagtggtagcccgtcttcattaattgttaactttataaaaattttattacttttgaaaatgggctgtgggtgaagttttctcacttggtaagaattttcaatgtgcataatgattgcccctaaatttacggtcatttataaatgcagtgtgttatttgatgccaaataatttcaaaagcaaaattgtcagtttcaaaagccaaataattatatgtaaaattagaccagggtgcatttaaaaaaaattactatgggggtggaatcagttctctgataatggaagaatggagagataagaaggccttaaatgatactgtgtgaaagtattatttctgttatggtttattacagatctgcttatttctcagctcatctaattctaaggactgttttgttccatgaatactataaatagggaacagctatcactcaaaatgggctccaaactattaacagccttgtgttgttctaagctgatcaggctgtaagaacctggtatttttattttttcttttgctaaagcttgagtctgttatttgaagcccatttctagtacagtccccctccctgcttttcctttgctgcttttatgggtcctatgtcctgatgtccaaagatatgtccagactttgccccaaatcagctttcatccctgagatttagttaatggactcattttatacacacatacacagacatacatgcacatataatgtatatatgtttctgttttctcatgtctttaaaaaattgtcttgctatatctgggagcttttaggtacattaaaaaaggaaaataatttacacccttttagtgtatttatactttgaattgtggaattaaacattatgggattgttaaggattcaagtctcagcatcatccaagtgatgaagtgggttgatatttgggcctccatggggtctggtgtactccactaagccctttggaagtaagatactggttatctgtctttatgmtctttatatcttaggaaagataaggcatgcaactatgatccaaataaatcagaagaatgaatactgggcagaagatttttgcaaagggcagaagtactgtgtgaaatgaaccatcattttattatttttttctttatttttatttttttattttgtagagacagcatcttgctttgttgcccagggtggtctctcaaactcctagccttaagtaatcctacyaccttggcctcctaaagtgctgggattacaggtgtgagccactgcgcctggctgtgaaccattattttaaaggagaaaatagttaatattattggaaatttagcatattaggatttagaatttagcatataattatttttctttaattattattaaatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtggtaagtactttgcaggtgaggaacaaatgttagatgttcatggtatctctaaatatgatctatcatgtatggtttataataaggatatctgatgaagtgtaccttcagataattatacaagaaaaacatttttctcacaatattatatgttaaatcgctagttacaattttctcatggctacttggtacttgtagcagtccattctcacgttgctataaagaaccacttgagactgggtaatttataaagaaaagaggtttaattggctcatggttccacaggctgtacaggaagcatggctgaggaggcctcaggaaacttacaatcatggcgaaaggcgaaggggaagcagtgacatcttcacaagcacaaggctagcaggagagagagtgaagggggaagtgctacacacttttaaacaaccagatattgtgagaactgtcatgagaacagcaaggaggaaatctggcctcacaatctaatcacctcccaccaggtctccccctcagcattggggattacaattcaacatgaggtttgggtggggacacagccaaaccatatyaatactctatgctatggagagatccagatggtcttggtccatgtgccctgagattttaaggttgaagatagacacaatggcagacatatgtgtggacartgtacagatagcagaataaaacactaagccaacacaagcatggtggcaaagtgttctataaatttcctctagggatttgaaattaaacatgaatgactatggtattatatctagatttggaggaggggatagttaaagagaaatgataattggctgatataaaataccatactaaattaatattaggattatttacartcagttttctagataaatgtaatttgtgaattatagttttatttatttatttctttgagacggagtttcacycttgtcacccaggctggagtgcaatggcgtgatcttggctcactgcaacctctgcctcctaggttcaagcaattctcctgcctcagcctcccgagtagctgggactacagtcacccaccatcataccaggctaatttttgtatttttagtagaaatggggtttcaccacgttggacaggctggtcttgaactcctgacctcaggtgatcagcccacctcggcctcccaaaatgttaggattacaggcgtgagccaccacgcctggccaactcatagttttattgattttctggcagtttatgaataaatttgctcatttrcagacttacstggactctgctaaaggtcttagactttttaaggcccttcagaacaatcagacaccccttttctgttgtaagttaagcacaaatggaactctgtccaagtgaaaactaattctctttgctttttctaatttctacggtcagtggcaatatcaacaaaaattcttaccatctgaatgtctccaatgtgccttttaataccttattttgactgcataactctgtgttaacttgacatttgcttaaccaataagcccttctttcagagagttagcattcctgttggtgttagacagctctaaatgatatttttatccttgagaagcacgttttatctagctacaggcatttggacctatatacaaatagtaaagttatttacttttaagctttaacatatgtaatgtgctattttatatttacctaaaactccttctaaagaacagagttgatagtatataattcctacttagtgcatttagaaataccatctggcttaccgccagagttaaccatgtgtgcgaactgggactcggaaaaatgaaaacagcygtttgcccttcaagcattttctttggggctgtcctttacttcagcaaccacttttgggctgatgacatcctgagctctgggtccaggctgcacctctctcgagctccaggctcctgcatccaaatttttattgaacagagatacttagaatttactctggctcctcaaactcagtgtggccaaaattgatcttatcttcttttaccctcgacactgttttccctgtcacaatgggtgtcactcattgcctggtcagtacctgggagtcaccttttgagtattggtaattagtctgaaattcaaagggctttgctgttgtagtatcactgcagtcaggctctgtgccttcagtctgggcagtgcagttttatacacactgattttaggtttctcagtgtgatacatatcacacagggtgatagatattgtgggtaytacagtgtagaccatttctctgattaaagaaaaagggaatttggctgactgaaaaatttgttactttaacatctgtacctggtttttgtaaatgcttggtttgtagattggtatataaatttacatgtgtatccttatgtactgatagtccatctctctaggctctagagaaagcctctgggctagaattaaggatgttccttaattacagttagaggagctataacactgcctccaacccataagatccctgggtgtccattccctccagaggtgtctgtaatccagactttgaagatgataatttccttgcttttagttggagcttctagttccagccttgccaccttaaacgttatatacaaatgtaaatatagtgtgtgtattcttttgggttttgctccttttgtttaccattttgtatgtgagatttatttacatgtgtcgctgtagttctctcattgccttttcctatttcattttatgatctacagtttattcattcctgttgatggacatgtgcattctttctagtttacagttgtacagagaatgctgctgtaaatatttttgtatgtcttgtatcgtatacaaatgcctgagtttctccagagtatatccttgggggaggaattgctgaattatagggtgtggatacttcaacattcctagataatgccttgctgttgtcagaagtggctttccatcagtagtatatgaacatagggattggtgatttttcctctttttagctaatgcagcctgtaactagcccccatggctttcataagcatccgtagtggctaacagtgtggattggggagtagtcagatttcctgggtttgaatcttgactctactccattgtcactctgggaccttggctagaaacttcctatcacttctccaaaccatgatcttttccagtttatctttgctattattggcttaggatgttagggagcaggttcaagttggcatgattattctactggatagactgtctacttgggcttcattcagagtttgataaagtatacattttatgtgttactttgatgtatgaagtagtaatttactacagtactggtggtctggttactaggaccatgtcacttgttactttgagtgataactactatttgtacagtgctttatagtttacaaataattcctgtttattttataatttgatccttacaataaccttatgagagaagtaggctggtttggttccatttacagaggaagaaactgaggcctggcagtgtttggtaacttgccatagtcactccgttaggtatattaactccaggccttgtattcagggcggctctcggaaatctgatttatagtatcatttagatatctgtgartctgactcttcgtgtaagagtcctgaaaagcagacaggtttctaacactttagaaatagagtacatacatactccygagtgtatcatctttactttttccatgtttatgctgtgttatagccataactggggaaatacattttttctgtaacattatatttgtatttgtttttagggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttaggtaagttggcacatcactggaatataataccgattctgaaacttaggtttagttccaaaactgatacttaytaaagttgctaaaaatagtttttacttacaaaaattatatttccactgtagtastggaaatttaaaaaaaaaagtaaaacaacaaagctgggcatggtggcacatgcatgtaatctcagccacttgggaggctgaggaggaaggattgcttgagccccggaatctgagaccagcctgggcaactaaggtgagatctcatatctaaaaaacaaatagaagaaacaccacctacccctactatcaccttaatgtagaactttagaaggcagtctttttgaagaggtttctgatatttaatgatattatttgataattatggggtttatgatatttaattattggtaatcttcagtttctagagataatttagagttcacttcttacaaagtttatgtaactttggagatgctttgtctgtgctgcaagtttcaattcatggctgtgtccagtggttttgtttactggatctaagatcagaccacttacgtatgaagcagtgkgctaggcrctgtgcgtacagaggaagaagatgtggttatgatatatgtctggcagagtttacaacctcacatgagagtcagatgtgtgcatacctaactggacttaaaggcatgatgtattaagtgctaaacgtgaaggtgccttgttggaaagactccgtactgccacctggagtgtggtgggaaagagaccagaaaggtgtgctggggcttcagcgaagtagactgtatattgacgaatttggactttggactaggcagagaagcccatgaggattttcatgtagtaggtagacaaatcatttagaaaatcgaggccaggcacggtggctcacgcctgtaatcctagcactttgggaggctgaggcgggtggatcacctgaggtcagcagttcaagacagcttggccaaaaccccgtttctactaaaaaaaaaaaatacaaaaattagctgggtgtggtggcagacacctgtattcccagctaccccggaggctgrggcaggataatcgcttgaacttgggaagcagaggttgcaatgagccaagatcacaccacttcactccagcctgggcgaaagagcaagactcttatctcaaaaaaaaaaaaagaaaatcaaactgattgattaagtgaagttccatatgtttctttgtccttagtgttgtgttcattttcatttgaatttaatttctttcgaagtagctttcataatttgtttttctgattataaaactaatatatgttcattcagaagacaaaaaaaaaaggataaattcataagttgaattctgtaacccagagaaaatgactgttaaacattttggcacattatttccrtgtgtgtatatcacttttttccatttgtgaacttgcattcctgctgcaaaatcacttttstattcygtggtttttttttttttaactttacaattccccatttttaaaaactttattgcagaamatttcaaacatacacaaaattatacagaatagtgtcatgaactcctgtcactctattagccagcttcagcatttctcaggaccattctcatttttctacactccctccccttttctctctcccttgattattggctttgaagcaaatcctagggagcatcagtttatcctctaatatttcagtaggtacccttaaaaacaaaataagtacatgacrttgtcatataagtgtatcataatttatccattccatttttattatattcatttttccagtattataaatactgttatgatgaatatccatatacagaaatactcatgtgcgtttctgatgatttccttaagataaattcctgaaaatggaattaactggatcagaaggtatgaatgtttataaagctcttgattgcttgctagaaatggtaatatcaatttatacttctaccagtatagtctaggagggttctttgaacctttgctcacattgagggtgatcatttaaataatctttgccagtcacatagatgaaaaattttgcatcaaatctcttcattttgatcttaatccttttctgaccatgtgttcaaacttgaataattaaaagtcaaacagtaaacttgtaaggagagctgcttttacagaactaaaaaaattaataaaatctggaaaaaaatttttaaaggtaggcttctatattgtattttcaatatttcctatcatttccttgctagaaatggtaatatgagaaatggtgatcaagagctttataaacattcataccctctgatccagttaattccattttcaggaatttatcttaaggaaatcatcagaaatgcacatgaatatttctatatatggatattcatcataacagtatttgtaatactgaaaaaatgaatatagaaatggaatggataaattatgataaattatgataaatgrataaattatgatttcctgtctttgatttagttcatttttctttatattttattaacttagtatatattttattaacttagtatatattttattaatttagattgagtaaagtcaatcaattttatcaacacattcatttttttgttttctgcttaattttataaaataacaatggygaaattcaataaaatatcaaaatatttcataatgacattgtcaaaagtgaatttttgtttgtcaagcagcattcattgactggtgatattcctaaatgtttsttcatcacatgagatttaaaagcttgaatttggcatatcaaagataatttagstgtcttatgtgggttttaccaaatttaatgcctgcttttgtcttattttaatttgaatttctctagttagcattgtaaataattttctctatgtttactgaccgtgtgtaatttttcaatctttgcacttttttttgtatcctttgatcattttcactttatttgcatattggactaagcgaagtcaaaagttaaatctgcatttctgtggagttcctacagctaatttatatctatggacagaatgaagtagaggaaattcaaaagttagcaggggtcaaacagtgtggactcttgtgactcagggtttgagttggaaaactagctcttccctttagtgactttgagtaagttatctactgtattgtccttcagtgtcctttatattgggggtattaagagtgcttacctcatggggttgttgtgaggattaaataagttaatataggtaaagcgcctgaaatagtacctgctgtagaaggctctctgtaagaggaagtttttttttttatattttaattaaattttctgtggctgggcgcagtggcttatgcttgtaatcccagcagtttgggaggccaagtcaggcggatcacaagatcaggagttcgagaccagcctgaccaacatggtgaaaccccatctctactaaaaatacaaaaattagccaggcatggctaaagttttttgtaggtacataatagatgtatatatttatgggttacatgagataytttcatacaggcatacaatgcataataattacatcagggtaaatggggtatccatctcctcaagcatttatcctttgtgttacaaacaacccaattatactcttttagttattttaaaatgtacaattaaatgatttttgactgtagtcattctgttgcactatcaaatgctaggtcttattctttctattttttttgtacccattaaccatccccagttcccttctcagcctctggtagccatctttctactctctatctccatgagttcagttgttttaatttttagctcccacaagtaggtgagaacatgcaaagtttatctttctgtgcctggcttatttcatgtaaaataatgacctccagttccatccatgttgttgcaaatgacaggatctcattccttttcatggcagaatgctactccattgtatatatgtactacattttctttacccatttgtctgctgacagacacctgggtgctcgcaaatcttagctcttgtgaatagtgctgtagtaaacatgggagtgcacatatctcttctatatactgatttcccttcttttgagtatatatctagcagtgggattgctggatcatgtggtagttctatttttagttttttggtagttttttttcaaactactctccatagtggttgtactaatttacattcccaccaacagtctrtgagggttcccttttctccacatcctcaccagcatttattattgcatgtctttggataaaagccattttaactgaggtgagatggtatctcattgtagttttgatttggatttctgtaatgaacgatggtgttgagagcttttcacataccaggctgccattgtatgtcttcttttgagaaatgtctattcaatttgtctatttttaaattggataattagatttttcctgtagagttgtttgagctccttatatattgtggttattaatcccttgtcacatgggtggtctacatacattttcttccattccatgggttgtctcttcactktgttgattgtttctgttgctgtgcagaagctttttaacttcatgtgatcccatttgtccatctttgctttggttgccctattaagaaatctttgcccagttcagtgttctggagagtttccccaatgttttattttagtcatttcatagtgtgacattttagatttaagtctttaatccatttttgatttgatttttgtatatggtgagagatagggtctagtttcattgttctgcatatggatgtccagttttcccagcaccatttgttgaaaagattctttcctcagtgtatgttcttggcaccattgtcaaaaatgagttcactgtagatgtatggatttatttctgggttttctgttctgttccagtggtctgtgtgtctgtttttatgccagtaccatgccattttggttactatagctctgtagtataatttgaagtcaggtaatgtgatacctccaattttgtcctttttgcttaggatatatttggctattctgagtctttcgttgctcatatacattttaggctaattttttccatttctgtgaaaaatgtcactgatattttgatagggattgcgttgaatctgtagattgctttgggtagtatggatgtttgaactattcttccaattcatgaacatgtaatatctttcccttttttgtgtgttctcttcaatgttttacatcagtgttttatagttttcattgtagagatctttcacttctttggttaactcctagatattttattttatttgtagctattgtaaatgggattacttttttgatttctttttcatattgttcactgttagcatatagaaatgctgctggttttttgtatgttgattttgtgtcctgcaactttactgaatttgtttgatcagttctgacagttttttggtagtctttaggtttttccaaatgtaagttcatctcatctgcaaacaagaataattagacgtcctcctttccaatttggatgccctttatttctttgtcttgtctgattgccctagttaggactattatgttgaatagcagtggtggtagtgggcatcattatcgtacttagaggaaaggcttgcaatatttctcaattcagtatgataatagctgtgggtctgttttatatgttgcttttgttatgttgaggtatgttccttctatacccagttgtttgagagtttttattatgaagcgttgttgaattttatcaaatcctttttcagcatcaawtgaaatgattatgtgtttttttttcttcattctgttaatatgatgtatcatagtgactgatttgcatatgttgaaccgtctttgcatctctgtgataaattctacttggtcatgataaatgatatttttaatgtgttgttgaattcagtttgctagtattttgctgaggattttcgcatcaatattcatcaagagatattggcctctaattttctttatttgatatgaatttgtctcattctggtatcagggtaatactggcctcgtagaatgagtttggaagtattctcctttttttttttttttttttttcccaraatagtttgaggaaaatgggtctagttctttaaatgtttggtaggattcagcagtgaagctattgggtcctgggcttttctttgctgggagactttattatggcttcaatctcgttacttgttattggtctgttcaggttttggatttcttcgtggttcaatcttggtggattgygtgtgtttaggaatttatccatttcttctarattttcggatttattggcatatggttgctcatagtaaccactaatgatcctttgaattcctgtagtatcagtagtaatgtcttctttctcatctctaattttgtttatttggggtttctctcttttttcacagtctgggaaagtcttaccaattttatcttttcaaaaaactaacttttggtttgttgatcttttgtattttctttgtttcagtttcatttatttctgctctgatttttatttttattttatattaattttgggtttggtttgctcttgcttttctagttyttcaaggtttatcatttggttatttatttgaaatktttcctcttttttsatgtaggtgcttttagctataaacttccctcttagtacagccgtcactgtatcacataggttttggtatgtgttttcattatcatttgtttcaagaaatttttaaatttccttgttgatctcttcattgacccactggccattcaggagcatattgtttaatttccatgtgtttgtatagtttccaaaattattcttgttttcgatttctagttttatttcattgtggtcagagaagattcttgatattatttcagttttttgaatgttttaagacttgttttgtgacctaacatatgatctaatctcgagaatgtttagatcattcatgctataatgatcagatcctctacatgctgaggaaaagaaagtgtattctgcaaccattgaatgaaatgttctctaaatatctattgggatcatttggtctgtagtaaagattaagtctgacgtttctttattgattttctgtctggaagatctgtccaatgatgaaagtggggtgttgaagtatccagctgctattttttttctctctcttttttttgagacagagtcttgctctgtcacccaggggggagtgcagtggcatgatctcagtacactgcaacctctgcctcccgggtttaagcgattctcgtgcctcagcctcccgagtagctgggattacaggcgtgcaccaccacgcctggctaattttttttgtattttagtagagacaggatacggggtttcaccatgttgtccaggctggtctcgaactcctgacctcaagtgatccgcctgcctcaggcatgtatatttacaattatcgtatccttttgctgaattgacccctttgtcattatataatgaccttctttgtttccatatttacaaccagtaaacaatacagtattaaatttgcaagtacaaaatttgttttgtttttggtgatatcttcttgtctgttttaaacactggtaagtagtttcttgtatctcagactaagtaccccatttttttcttatgctatatacctaaaggtaaaaacagcagtttttgtcagttactggttaataatattttattaattttgaagacataatatgttaaagctgtgtgaggaaaggcaaaagaatggcttggaattgtggagtgtctatcttaaaatattagggtttttggtattcttaactttaaccacaagaggtctccaaaggatttgatattttgtgaattactgtttartggttactaaaatcttcacatttctttttatatctgaaagtacaggtttatttactttgtatcatattgtgacttagaacaaatattagagatgatagtaatctaaaattattactcctaaataatgatacactatcaatttttcttagattatttatttttatttatgtaaagtatgtttgtaagatttcagcctgtgtcttagggaatcagtcttactatcttgttacactttcttttgttgtaaaaatgtagagaaagaaacaaatggaaagcaatagtctcragccctttatcaattgcagttaaggttgctttagcttagaaatgttgtatgtttatagaaatggttgagaggaaagctttagaaagcgataaacaaataatatttactagttctcaaggaaactgacttttcaggtgaatcaggtgaacatcacaaatgacactcaattttgcgttcaaagaaatgagagcttcctgagcactggcatagccaaggaaggctgtatgaaggaggtggggtaggctggtacatttgcagaatagaaggctttgagttggtaatggggaggggggaagggtatgttgtgtgtgtatggaaatgatatgaggtctgaggcacacaggctggaaatattagagaagtgtgaagacagaagggagatttctctgattagagggaactttcatgttgagaattgagaaagaaagggtgaaggcctatgaaatccagcaaactggtatggattcctgtagaaggcagtaaggtttctgggaaaaggaatggcatgatagaagggaagagatgagtgtactgcctagatgggacagttgaatttkaaaaataaatatttccctaaaggaaaaagcggatacagagaaaagaatcagatcaaggagcttagagaatgccaatagttgggaataggagcaagaatacaaacagaaggggaggaattaaagagctaggtggasaaccaggacaaggtagggatgtgtagttataatttgtcacacgtggtataaccaatgatgtgagctaattttttacattattgactctgttatagtttactgaaactgtatgacattcagaaagatacttggttaaaaactagccttagctcattgatatcatttgaaaaagacatgtggaagaatgtcctgtggtaccacagtgactttagctatctgacctttgaaataaatgcttgaacacataagtgcttcctcaaagatagatgtgtatgctgcagatttaaagaaaacattgaaatcttaatgttggggaataagaataacctctactatgtttactttcagtgttagaaataccttattattatgtctttttggccacagagagccttacatcatctgaggtttaaccaaaagtattatctaacatgattctttatgcggaggcatagtaccacctgaatgtcacttatggtgacacgtgtttgaaattaccatagtagcattttcattttgtgttcatctcttattaaattaatttatatagtagaaatcacttattactttatgttattgtactttgactttcaagtttttaatggaaaatatttagcagagttttggtgccaaaatgaagtgataactgtgagactatataattatcagaggaattgttatgcaaattaggtatctgtgttatgactgaagtccaacttctttctaatgtcatttgaattaaacattagtataaaggtttcaattttttttttttttaaagaatgagagtaaaagaaacaacaggtcttactcattaatttggttaagaggaagtgcttcacacatacgaaatgttattaagtggtcggtacttgatggtaccaatttcgtgattgcagtgttacagttctatcraagtttaataagctcaattctgtgggttcatatgaagtcatttcaatataattcttagatatttagagccaagtaaatgtggaatggcataccaaacagtgggtagcatatagatatgaataacatggtgcctaaattaggtgggaaggtgggactgggtagaaagagggcattccaggaagtgtggtcacaggatgagaaaagggaattgggaacatcgagttgactggagtgttaggaawatatgggtcaagagtakcctgcaacagaatgtagtgcagaagagctgttcagtgagtatttgctgaatgattatgtttaaggccagagaggaagactggagctgtttcattgaggatgctggctgggcactagtgggaggagcttatactttatttagatgtttctcaaatttggcctaccaaccttttaatttactactttgtgttagaattttcttatttaaatttgttaaattataattttaaaatttacaaagttaatacatgtttgttgtaaaagtgaaaaaagtctattttaaaggaaaaaataattcttgctaacctcctcacccatttcacttaaattarttttattataatgtgacttaaatayttataaactgaaaacttagtgctctaggttttatacctattttaacaggaataaagtccaagcaaaatttgagattaaagtaaatgtatgaaacaaataaaatataaatgaatgattgtttggtatgaagggtgatgttctgctgctaaaaataaactgttcctaccagttcaaggggatatatccccaacggaagaccgagttctttttttttttttttgatctttattttattttattttattttgagcagtttgaggctcacagcaaagttgagagtaaggtacagaataaaagtgtcatatcatcagtattctccaccagatcctgtgctatgatattgctgtaatatgctgtgtaaaggctcaaaccyttcctgcatgatttttttaaagagtaggggtctcgctctgctgtccaagctggattgcagtggtgyggtcatagctcattgcagccttgaactcctgggctcaagagatcctctcacttcagcctcctgagcagcatactaatcaggcacatacctgtagtcctggctactcaggcatgcaccaccccttacagctaattttttwaaaaaaattttgtagagatgggttctggctattttgcccmggctggtctcgaactyctggcctgaagtgatgctctcacctcagccttgcgagttcttggaattataggcatgagcgactgcatttagcatcttccagtctttttctttcttcaaaccacagtatgacttaagtggtttgccctccgttgggtaccagtgtaccagttccatttttgttgttgttgttgttgtttttgagaggaagtcttgctctgtcacccagactggagtgcagtggcacaatcttggctcactgcaacctctgcctcctgggttcaagcgattcttctgcctcagactccccagtagctgggattacaggcgcccgccaccacacccggctaatttttgtatttttgtagagacgtattttcgtaggggtttcgctgtgtaggtcaaactggtctcgaactcctgacctcaaatgatccgtccgccttggcctccaaattgctgggattacagacgtgagccactgcacctagccatccagttcaattttaaaactactgttttatttttctcattaaactttaaccgttaagtgctccttattactaatgtgatcttaaacataaacagaaatgcagaaactgaagcacgtagcaatattcattttaaaagctgataatccagttgatctaagaccttaacctaagatcatgaaatcagttcggtaggttgtgactaacattttaaaaaaatacagtagaagttaccagagtatatcacgtgtagtaagggtaagtatttcatgaaattcctttttttcagttttatctgtttatagataatctgtctgtatatgccttctaatcctctctccaattcctatcatgtttgtaattgtccatgaaaataattaaactcataatttaatatattaatatgattaataaatgttattcatagattattttatatatacattcttattacctgaaactgatcagatactgcccagaaatatatttttgaatagcacaactgaaaagtagttaatatttagactacgtatttaaaatcctaaagctgacatgattcacagaccagatattgcctacatagaaaatctagaagtgacaaattatcagaagtaataagaattcagcaatgccattaaatataagatcagtttataaaaatgaatagtgtttcagtacagcagcaacaaatagaaaatgaaaaaaattttaaaagatactatttaaaatagcaaccacaataatattatctaagactctatttaccaaaaagaaaataaggtcttaacgaaaatttggaaactttactgaaagatattaaagaactaaataaatactggaaagatgcaacacgttcatgaatggaaagattcagcataaagatatcagttctccttaatataaattcaatgcaattcttttttttttttaaataacaattttgtgagtacatagtagggtacaagagatgtttttcagtgcaattctaatcaaaagggcaatgaggtttttcacagaaactgacaagctgcttttaaaaagatagatcaaagggccaataataagtaagacagcactgaaagacttagagctatttgccctatcaaaactcaaaacttacatatatatgtgtgtgtatatatatatttatatatgtacatatatatgtttatatatttatataaatatatctaaataataatatagtatagtattatataagatagaataaacatgtaataatattatataatagctaaacatgtatgtttatatagataaacgtgtatatgtttatatagataaacatgtatatggtttataatagataaacatgtaatatgtttatatagataaacatgtatatgtttagatagataacatgtatatgtttagatagataaacatgtatatgtttagatagataaacatgtatatgtttagatagatagataaacatgtatatgttagatagatagataaacatgtatatgttagatagatagataaacatgtatatgtttagatagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttatatagagagataaacatgtatatgtttatatagagagataaacatgtatatgtttatatagatgaatatatataaacatgtatatgtttatatatgtttatatagatatatatatacacatgtatatgtttatgtttatatagataaatatacatacacatgtatatgtttatatagataaatatacatacacatgtatatgtttgataaatatacatacacatgtatatgtttgataaatatacatacacatgtatatgtttagataaatatacatacactgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttagatagatatacatgcacatgtatatgtttatatagatatacatgcacatgtatatgtttatatagatatacatgcacatgtatatgtttatatagataaatatacatgcacatgtatatgtttatataaatatgcacatgtatatgtttatataaatatgcacatgtatatgtttatataaatatatatgcacatgtatgtgtttatataaatatatatgcacatgtatataaatatatataaacatacatatatacacacacacatatacacacacacacacacacacacacaaacacatatatatatatgttttttggagatgggagtctcactctgtcacccaggctggagtgcagtagcacaatcttggcccactgcaacctccatctcctgggttcaagtaattctcctgcctcagcctcccgagtagctgggactacaggcatgtgtcaccacgcctggctaatttttgcatatttttagtagagatggggtttcaccatagtgtccaggctgatctcgaactcctgacctcaaatgatcctcctgccttggcctcccaaagtgctgggattgcaggcatgagccaccatgcctggccaaaactcgaaacttataaagcaatggtaagttagtatggaattggcatatggagagagtagcaaatgaagcaatggagcagaagaaagatggagaaaacaaattcatgcatacataggaagttcatatggcagagatggcattagacatcctgggagggagggattattcaactgatgctgcagggacaaacagctttccatactgtaaaattaaaccctacttcagaccatacagaaaatttcagttggaaaatatatatgtattcattacctcaggatctgaaaagatatcctataaatgacatacacaaaaagcacaaatcaaaggaagtaattagtaagtcatgtagcttttttacaggttgctctaggtattacattatatatacataacttatcacagtgtacttgtgtcattgttttaccagtttgagtgaaatataaaaactttacctctgtctatgcttctttatcctcccccatttataatataattaccttaaatattataattgtcttaaatatttagaaagcgttataatttttccttgaaccatcacacataatttaggaaactcaggaggggttcctattgcttaccttgctgtttctttcctgatgttctaaggtttctttttttttattttttcctttttgtttagagaacttcctttaaccattcttttagagtagctctgcttgtgtcagagtctgttagtttttcatcatctgagaatgccttgatttgcctttcattttttggaagatattttttgccaggcatgggattctgggttgacaattattttttcagcacttgaaaaatattttgccacttccttctaacctttatggtttcagatgagaaatctactatcattcaaattgttttaccctatagctaaggtatgatttctttcttgctgctgtcaagaatttttttttttttttttttagtttttagaagtttaattatgtgtcatggaacatatatctttggctttatcctttttggggttcactcagcttcttgaatctgaaagttgatgtctcttgccaaatttgtgaatatttcatctattatttcttcaaggtttttgttgktggtggtggtgttttttttgttgtttttttttttttttgcctttcttttctcctcttgggactttgatcacaagaatgttagatcttttgttatagtccctggggctctattcattttatttttattgcagtctgtatcctctctgctttccagatttggtaatttctattgttctgtttttcatttcactgattgtttcatctgtttcctctattgtgctgttgagtgcatccactgttattatatttttcacttctaaaatttttgttcattttttctttttttttgagacagagttttgcttttgtgcccaggctggagtgcagtggcatgatctcagctcactgcaacctccgccccccgggttcaagcagttttcctgccttagcctccctagtagctggtattataggcgcmtgccaccacgcccagctaatttttgtattttagtagagatggggtttcgccatgttggccacgctggtctcaagctcctgacctcaggagatccacccatcctagcctcccaaagtgctgggattacaggtgtgagccactgtgtccggcccatttttttgtttatgccttctattacgttgcagagaatttttccttgccttgactttctatttttccatttgtttcaagcatgtgtgtaattgctgttaaaacatttagcatggctgctctgaaagctttgccagttaattctgacatctctgttatcttggtgttggcatctatcgattgtcttttttcattcagttggaggtttggaggttttcctgttatttggtatgatgagtgatttttggttggaaccagtgcttttttgtattatgttgtgagattctgggtctcatttaagccttctgttctagctggctttccctgacactgcttcagcagggtaggggtgtgctgcctccttattgccaggtggaggtagaaacccaggttgcttggtttccgttgaaacccgagggagatgggtgcttcttgttactgctgggtccctggaggagttccagcttcccatgtggcctccactgggccttctctgacaccatccccgtaaggagtgagaagggagtctcagtactgcctagtgggtgtggaagtccagtctctgtctggtgtttcgcctgataccatgggggttaaagcctcagtattggccagcaaggatgaacctcttgtttgctactgtatggctgacactgacacaatcccaactggagtttggagtgccttctttcaccagtgagaatggaaatctggggtcccagcctttgctagcatgggtgggaccacaggtttttctctgatgcttggctagagtagagcggttattggctaaaagttttctgtcttgctaggcttcctcttctctgggggtttgttgaggcttttttgtctgtgcctgttggtctttccgggttgtcagctttttcagctccaagtctgggttttatgctacaaaaagtaaacctggggaactcaccgtcatactgttcctcacatcccaagttcmctagctggtctgctttctgctcacctttcagagtcgtcttatgtttgtttgacatgtaatatgcagggagtggtacttagagtaggagtggggaaacatatctccattccttcttcccagaagcagaagttcttcaatcaagatcttattttagagattgctctatgtataaatgaactttgcttccttggtgttattttgatctaattataataaaatttggacttagattatattgataatgccagtgtgcaaattttaactgcaatagaattgaattttgcacatgggtgaatctgattgagaaaaagaaaatcctattttttataattaaaaaactgcttttaatatttttagtgctgtttacagtttaagaatgttagtatatttttaaaagcacaaccagtggggaaaattctatcccttttcttggcaaattaacaatctaagcatacaaaaatttrtaggaaaattttgccagctctccatcagagtgctgtcatgatgattagttcatatttccttcttacgaagcttgccctttcttgtttatcacccacagaaaagcatcaaagttaaaaattaaaagtatttgaaggaacctccataccaagtggattcagagagcccagaggtcagaaatcgtgcagagtcttatgttgacagaggaatggccctgccataagaaaggtgcctgagttrtacaaggtgttggcagytggagccaagttacacctggtttacttacctgatataattttaagtgcttcacaaataacgttttttaccttcatagttaaatatttacttaaggtatattaaaaacatataatcagtgaatcaaacctgtgatttcataaatgtgttgcaaagaaagattcttaagttggtatttgagttaaaaatgtgagttaacttaacaagaactatcaggttatagtagtgatgtccttacaaatatgtcagtattattgaaggtaaaggggaatgactgaagttaaggaaacatgttggagcaattgtaaaggcaatgtgtgtcacattttctgccacttgtcatttagattgtgtaagctaaatctartataagtgggaccattgtttgaatgaaaaaaaatccaaacttgagatgtagagaaatatagatgaatttgaagcccagaaaggacatttaagctctcttaagatgagttactccattttttatagtagctcacctttttaaaggtattttatcctgctgtcaagtttattttattaaattggataccaggaaattctaattgatttttttatatcaaacaaatcgatgttatttatttatttttgagacggggtctcactcttcctcaggctggagtatggtggcaccatcgtggttcactgtagccttgaccccccaggctcaagcaatcctcccacctcaacctcctgagtagctgggactgcaggtgtgctcaaccacacccagctaattttttttgtagagatgaggcctctctatgtcttctatactggttttaaactcctgggctcaagcaatccacccaccttggcctccccaaaatgttggaattacaagcgtggaccattgcgcctggccaaaatctgcattttgatggatgtttccagtagattctcaagttgttgatacatcttctaagttgaacattattatacagtcattcatttattcatccttaaacacagttattgagtggctgctgtgcgccagctttgttactaggtggcaaggatacagaaatgagaaagatccctcctttccaagttcttatagtctagaggggaggtagtcatggaaataattgtaatgaaagcgctggttgaaaatatcttagagttactggcagcccttgagcatcatgctagtttgctagaggggtgtgttagaattgagactggaagaatgaatgccagtcaggtggaggtgtgagagagcgtgcttttcttaggaagcagaaactagtttggctgggttactctgccagcatgagcaggcaacctgaggcaggacagacgtgttttggagagaaagggtgtataaagctggaaaccatcattctcagcaaactgtcgcaaggacaaaaaaccaaacaccgcatgttctcactcataggtgggaattgaacaatgagaacacttggacacaggaaggggaacctcacacaccggggggcctgttrtggggtggtgggggggacggatagcattaggagatatacctaatgtaaatgacaagttaatgggtgcagcataccaacatggcacatgtatacatatgtaacaaacctgcacgttgtgcacatgtaccctagaacttaaagtataataaaaatatacaaataaataaaaaataaaaagagaatcaagagtgaaacggtggagtgagaaagcggcattacacagggcctggataaagagtttcctgtgacagagactgagctgagatggctggtgatggggaccgtagcctagtgaccctttgtgtacccagcacctatcaaagtagctcacacataataggtgcttaataaatgcttggtaaatgaatgattaaataagtgatgtttagaataaagagaataatgggtatctcctatttgtttttcttaacaaaactgatttgggttttttaaacatagaagggttgttgtaaggctgggcgtggtggctcatrcctgtaatcccagcactatgggaggacgagatgggtggatcacctgaggtcaggagttccagaccagcctggccaacatggtgaaaccccacctctactaaaggtacaaaaattagttgggtgtggtgtcagcacctgtaatcctagctacttgggaggctgaggcaggagaatggcttgaacccgggaggtggaggttgcagtgattcaagattgcaccactgcactccagcctgggcaacagagtacaacactgtctccaaaaaaaaaaaaaaaaaaaaaaaggttgttggagtagctggaaatctatacattaacatatatggtaatcaatgtctatttacattatatagatttacattatacagatgtagccaattcatttactcttttggaaagatcatattgatttcttatcgttttttccccattatgtttatttctttaaaaaatkttttaatatcactgtaaattgattgaagcatcctgacatttccatagatattcctttacagcaaatattaatgggatctacatggctaagttactgtttaaagattgatattgatgataactaggcactagcctcccctctggcgcttgaaaccttttctgttgtggtattcgtaggaaatctctttttttctttatattttgtcttccccattttcctcattcctcttttcgagagcagaagataaatataaagttgactactttgtcattctgtttcattatgtttattagacggtagtttcacttaactatttagataatctagaattagaaaataaattgtgggcctggcagggtggctcatgcctaaaatccsagcactttgggaggctgaggcgggtggatcacttgaggtccggagttcaaggtcagcctggccaacatggtgaaacctcatctctactaaaaatacaaaaaattagctgggcatgatggcacgtgcctgtaatcccaccttctcaggaggctgaggcaggagaattgttcgaacctgggaggcagaggttgcagtgagtcgagatctccccactgcactccagtctgggcgacagaacaaatcaattctggtagtagagatggtagtgactaaatggaagaaataaatctcatatgctgtaggaaaatgtttgccactgggaaaccatttaaagaggaagtgttattagtattaaaaaatctgtcattttgaaatttctttttaaaaattacattaatttcttccctggtggtaatgccattgtattttcagtaggttttttttttagtcctgatactttttgtatatctagctagcaattttaatggatgtgcttaactcatgaaaatccagattttaaaacatgataagttaataggtgatagttattttataagaacatttgccatgagtttatttaaagaatgagagcttctttgtgcattttcatcaagtgcattctcctcaggaatatatctccttgaaaagaaaaaatggggtgtatttgcagtaggtttattgatrgtcgaataggaagaaacagcatttgagaagtgtggagaaaagatcttcctgattactacagagacctcctaaagtggggccagactgcttgaacagaaagtttggaagcaattgtgtgaggtgtgctgcatttgttttactaattcgacttgatttttgtaaatacacctgttcatttgggtttgaggatttaattgcataaagactctttatttagctaaagcgtcttgtcctcatggcttttcccagaagtttgtgttataaatgttaatatattaaaagtgcttttaaatgatttattattagcatcttaaaaaaatcctacactaaatattaaagtagtctttattatttcaggtgaaggcaaagggaaacagtacgagttgcaaggtagggggtaaatggaaaggaagaaaaaggaaagacaggagatgaagggaaagattgagtcccatcattcttgaagacacattgttcatggcttcaataaccctggcacagccctctgaagaaagtgtagttatcctcttctttctgcaaggaggcagagatgctgtgaacctctcttgaagttacaggatcacttaggtagtaagtggcaaagcccactagagccctaaccctgtttgatactggtgagttcacctgctatcattaaggtgtaacctgacagcaatgtaaaagacaaaaatcccccttcactgaactccaaatacagttactgtctgtcctcaggatctctttatttttttcttctccttttcatggttcaaggagagatcccttttaatctcttcccttccagcaaagcttcctttcactttctacctgaagtcaaaaacttgaggccagcttagttcagagctcctctgggcttgcttatctcccagcctttgtggactccttcttgtccatttgtctttgtaatgacttcttcctgtcgaacctccctgctgaagggagacttcttactaatttctcttattttccctgcttgcttgctttgagattattttcttatctcttgttttcaggccaggaatttcttcctcctgccagcttttttgtgaatcctttttaacctctggcccaagtcttgatccctaaagcagtaaaagcctatggaggcctggtatggtttttctgtacagtttttcctccctcccttctttttctacccttctttctgaaaaaacaacagaaacaaaaaaaacccaaaaaccctctgatacttgattttgtatcaataatcaatatacattaatataaaatttattaatataaattgacttaatatacacaatactgagttttttccaggcttttgtggaagctccccactgcagtccagaatgctccgtgaccaggtcctaggattctttcccttggtgccattgtgactgctcccttattttataccttcagctctgtccagttctcttcttggcctggctgagctgggctctgcacctcatgggagtggacatgaatcctgaacacaccatgtgggtgtactgggttgtccccaaccttaatgtgaaggcaagtttagagaagaatgcatgatgagtgggcttgcatgcctccctgatggccatatgggagcatgaccacaccacagggttagtccttacctggtgggagccactgggagcagaggagtgctaggtatcgcatggcatatttaagatagtttgtgtccagccatgacatttcaagtgctcattaactgcatgtggttagtagctactgtataaggcaatgtagttttatagacagtagcacagctgtatgcaagagatgggcctagaaagacaggtaacacttaactagacagatttgggggaaaatacattcctcaatgaaagcaaagtttaaacaaggttgaaataatttatttaaaaaaaaaaatagctggctgggtgcagtggctcacgcctgtaatcccagtactttgggaggctgaggaaggtggatcgcttgagctcaggagtttgagaccagcctgggcatcatggtaaatccctgtctttactaaacatacaaaaattagctgcgcatgatggcaagcagctgtagtcccagctaattgggaggctgaggcaggagaatcacttgaacccgggtggctgaggtggcagtgagccgagatcatgccactgcactcctccctgggcgacagagcgagacaagcaacagcaacaaaacaaaaataaaaacagctaatgaagttcttattatgtacctggtacattctgccattactgaaattaactgatgtcatcttcacaacaatcctttgaggtgattacaattattatttaatatgtccataataaatgacaggtttaggaatgtacatttgaattgtggttctgactgaaacattgggcagttgaggaagtacttgataaagtgattagtgccctttttaagtgtgagcaatttctagttgctaagtcagggtatcatttatgtatgaattaccttataggtaagtatactttacattcttttatgtaactcctaactatcaacctccagatatcacaaagtttacttgtgggtgattaaattgcttaagacaagagattgcccacccatacagaatttctattgcttctgccttccagagaacagtgggagcagcctggcctgcaggttgattgtcagattctgcctccctcccacctacttattcctccagagagacacatagcttagcctcctgtcacactctgtcattttcctggggctgcagagcaaagggctccctcaggttaattctgaagtcctgtgtatgctgaagtctgcttgaagaaggagagaagcttccatcttgcatatttcctaatactttatctttccttctgtaacaacagtgcacagattttacttcaggaatgtgtttttattcactcctgctgttatcctgtatactaaagtagtcctttgtcaatgtgctgatgtgctctagaaacatataaagagttttttttttaattggtttgttgactggacgtaaacactagtataacactaaatctaagtgcagagagtgggcagcctgattttgttcataatctcaggggaatcttttataatgggccaggaagcacrtgtctgtggtttctgcatagggcgtgttctgtggtgcccagccagctgtagtatgtcctgcgagatttggcctgcaggccacaatggtgggcttctgggaggaagaatcttccttagaagtcctgccctttgacactccttctgctgaagtgtcctgatctcagtggggctccctgattttctgttccggggtctatcagcactgggtctatcagtgctacccacgccgccgtgactgtgggtcactgagggtgacctgcgtgggtcccatgggctcagcctggccttcccaggtcctacaaggtcctccttactgtccgtccctgctcagtcaccaaagaatgacttttttgaaagtacaattccagagttaaatactggctaagtgtagaaaacaatrctggaattcagtcttcacctccaccagtcctcatggtgagatgaagtgtttatgggtttctttgttgtaacctcaaaagtggaatgcatttcctggttggtgctgcttgccctccaggtgcttagtgagtgaagcttcatcttccagatttctctttgtggcttagggtatctgtatgattttcctgcttttgttttcagaggtgctaggctgtgctgatctctctggagtgattatggtgctttttgcctggtaagcccatccttatgtgtaaaaatcaggatttagatgtgaggcaaataaggtggtggtgattttgttttacagagagattttcactttgcaaacttttagaccttttcaaattctaatttgatttgatgtatttaaataacaagttatgtaaaaacattgaaatgacccattttacagaagtttggtttacaaacccattgtttgtgtaaggtaacatacctgaggccaggagcatgatacctttcctctagtcttgcccttgtccctcgctttgggctccagctacatcagagtaattgccatgctcacaaccccatacagtgagagcacagaataatggtctgggtacagtctggggccagacagcctgtgtttggactctatttttcttactacctgtgaatcttaacctctccatggctcagtttccccattcaaaaacaagtatatgttgatagaacgttttatagagtagcaagcattaaatgagttaatacagtgcatgaaacatagtgctcattaaatattacctcctgttattcattcagcatttatttctctaccattcttaagctattctcacattgtgcaatgcatttttgtcacatctgtctttttaaatattctgtatactaacagtcttattgctttcatgaagctgccctacaatttccagttgaggttctaatcttagctgtacattgggattacatgtggattttaaaaaatgccgatgcctgagtttttggcctgtgctagagcygcttgtagctgcttgtaagaattgactgttatagttccaggactttgtaccagacggtgaaagcattggtaacttgaaatcaactatgttgggaatatttgcactcgtaattggcaaatactaccacagctctctcttcaatctgtttgatgttctagtgatttgtttataagcctgtctctctcaataggtgttgaccattttggtggaatgtattagtttgccagggctgctgtaacaaagtgccaccaactgagggcttaagcaacagaaattcattatttcatagttctggaggatagaagtaaaaatatcaaagtatgaacagtattggctccttcttgaggactgtgaaggaaggatctgttccaggcctctccttgacttgtagacggccacctccttcttacgtctcttcatatcgtctttcctccatgcatgtctctgtgtccatgttttccctttttacgtggacaccggtcatattggattagggcccaccctgatggcctcactttaactctctgcaaagaccctatcttcaaataaagtcacattatatactgagggtgtggacttccacatttgaatgttatagggacataattcaactcrtaacatagggcgaggacattcttttccacctccctcctcagtccgtttgtgcctgtggtagttgcacagtaaagatttgtagatttgaaaaggaaataccttttggctgatgttatttgtatatacttttttattcattgagctatgaactccagagttagtatggtttaaaaaaactttttttgttgttttgttttggaaacakctccttcttgggaaaataagagttagtatttctagagaaaaatgttagtttagaaagagtagttattttaggctaaggcagacctgagcttgttaatgaacttgtggactcaaaaggcgtatgattgagtgaagtggtcttgattttgtgtcagtggctgacaaaaagcttttaatcatgcatgaaaaaaatgtttgtgatgaatttccactgatttgaaaatgtcttaatgttgctagtcctcttcaggattatgtaagactgtagagttcttagaagagtatggcctttcttgctttttctcaaaggcaaatataatgtcaggtaattttgctgttatgctattgaaaaaatacctcytgagtcacaggaagcataaattattttttaaagatttaccatgtgttaggatgattgtgtcatatattaaatatrtaatggatgacatttagactattatcatctcgaagcatgtaaatatagaatatactttttgaagttagttttcttcaaaacgagagatatttctcaccattgctttttgctgagtaaataccagaattagaatcttatgccaaaaatatatttggagtacacatttgcacaggaatttgtttttttccagactttttaatagaaaatctttaggtataaattacatacggcaaatataaaaagttttatttttaatcaattttaatcaggtgtaatttatatgcaataaaatttatacattttaagtgtatgartcaatcaattttgacagatacacacatcaatataactaccacccaaattaagatctagaacatttcatcttcccaaaacgttctctttgcctttttgcagtggttttctccccacctccacctcccactccaagcaactactgttctgatttctgtcactataggatagtttagactgttttagaatttcacataagtggagtcagtacagtgcatacttttttgtgtccagctcgttttactcagcataatgcctatgcaattcacccatgttgttgagtgtatcagtagttcattcctttttctcactcagttgtattgcatcatatgcatataccaacatttgtttatttacttgctgaacatttgggtttccagcttttggctattttcattaaagttactaacatttgtgtactagtcttctcacagatctatattttcattttcttcacataattaggagtggaattgctggattatgtgggtaagtatatgttcactgtataagaaacagccaggccaggcacagtggttcacacctataatcccagcactttgggaggccaaggtgggaggactgcttgagcccagaagcttgagaccagcctgggcaacatagtgagaccctggctctaaaaaaaaaaacaaaaaaaccccaaaaagccagatgtggtggcacaagcctgtaggcctagctactcagaaggctgaggtgaaaggatggcttgagcccccgaggttgaggcttcagtgagccataattgtgcccctgcactccagcctgggtgacagaacaagaccctgtctcaaaaaaacaaaacaaaaaagtaacagctgaagtaggttttggagtagtagttaatttaccctcctctcagcagtgtgtgagagctgtagttgctccacattcttgctgactcttgtcagtcttttaaactttagctattatagttagtgtatggtgtcatgttttatttttaacttgctttttcttgatgactagtgatgttttcatgtgcctattggttattcatttatgtatctcttttgcccattttgagacttggattacttgtattttttagttataagaattctttatacattctgaataaaaatcctttgtcagttataggtattgtgaatatttactcccagtgtatggcctgccttttaattttcctgattatgaccttggaacaacagaaggttttaatttggtgaagtcagatgcattagtgtcttcttttatggttactagtgctttttgtatcttaagaaatctttgcctactccaacatcatgaacattttctcatattttattttagttctatagttttagcttttaattttaatatattaaatagttggatttaactttggggcatcatgatatgaggcagggattgaggttcctttttctttgtacgtttaccagttgtttccacactgtttatagaaaagacttttatatgcattgaattatgttgatgccaaaggcttcattttgtctttgtttttaattaatatttatttatttattttttttagagacagggtctcgctttttcgcccaggctggagtgcattggcacgatcatagctctctgcatccttgaactcctgggcccaagtgatcctctcagccctgcaagtagttggggtacagattttcttgtggagatggagtctcacttatgttgcccaagctggtctcaaactcctggacttgatcaaaggttttgttttgaatttgactttgaaaaatgacctagatttttatgttcttatattagatatkttagactttgactttctaggatgtcatttaaaaatgtttttaggtctccctttttcttttttygagacacagtctctgtcacccaggctggagtgtggtggcaggatcttgattcacttcaacctccgcctcctgggttctagcgattttcctgcctcaccgtctcgaatagctgggattacaggcgcccactaccatgtctggctaatttttgtattttcagtagagacagggtttcaccatgttggccaggctggtctcaaactcctgacttcaactgatctaccctccttggcctcccaaagtgctgggattacaggtgtgagccatggcactggaccctctttttcttttttttcagaagttattgtatttatcacataatagaaataaagggtgggatgggagctctagaaatctaccatttcagcttcttccttagtagacccacattagcgatgaatataaaatagatatgtgtgtgtgtgtgtgtgtgtgtgtgtgtgtgtgtaccctgagctaatggaatttgtggaacatttggtaaagctcataaatattgcacaactggtacaatcttaagtaatcaattctaagtttttagggccgggtgcggtggtggcttacgcctgtaatcccagcactttgggaggccaaggtgggcggatcacgaggtcaggagatcgagaccatcctggctaacatggtgaaactccgtctctactaaaaatacaaaaaattagcctagcgcagtggcgggtgcctgtagtcccagctactccggaggctgaggcaggagaatggtgtgaacccgggaggcggagcttgcagtgagctgagatcacgtgagatcgcgccactgcactccagcctgggcgacagagtgaaactccgtctcaaaaaaagaaaaaaagagtttttaacaacttttgttaatttttcttatgtttaataataattatagataagcttttctttacctttggttttctcatatttgaggactgcaatttaaatgatcttcaggaacttcttttcttcttgtattttgtgaaatgaaatgcttttaaaggcatttcaggcatcagaggtagatgaggtggtattttgggcagtggcagttgtttctgaaatcacacattagtagcttttcctatcctttatcttctgttcccctggagtgaaaaaggtgctgttggaggcaaaatttgtggctactgaaaatattccttaatgctggtagcttcttgacttcgtgcctttcttacccaattacatctattctaaagctgtcccacttcttttcctttgagcayatgactactgctatctatctcctattcttaaccagcattaatwacactgtgtattagatactgttttaaaggctttatgtttgttgaccgacttaatcctcataaacacccttgtgaggttgctgctgttattttattacgggttttatagatgaggagactgaggctcagagatgttaagtagcttgtctaggttatacaattactaagtggcaaaactggaagttgatacagacttcctggctctaaagcacactatgtcatacagcctctcaggaaaaacacagaagggagcagctattcccttccttcacctttacttttgactgcaaaaggggtaatattttatagcacaattaaaattattttggttaatattttatgaaatttctttcccttataatgcatattacagtctgaatttctctctggtggtaaagtttctgacaaagcatctgtgcttaaaacaaagcagctttatttatgaaggtatttctttacaaaccacagccctggtatccagcagaaagcatgggttgtctttacatgtggttattcttctgggaaagcatcttagaggaggtgagccttgacctgcttgttaactgagaatatgtgcacaggtctggggtatagtatgtgtagattcgtggtaaaaagacttgggattgtgaggggctgaaagattaygaaaggataggggttttaaaatattattactaaggagttctgtccttagaaaagatttctaggatcaagaaccaagagctggacgatgatgacaacaggcagaaatgagtggcttctctcagcccttgacttctctgccattccctcccccttcgagtgttcccctttcctttggtttccaagttgcacgctgatcctcttagtgtttttaacctcattgcagacagaagtactttcccatcaggtttgccaagacagactagaatttttttgttagaattttacctttaaaaacaaaaccaaaaccaaccattacaaaagaagcaaaggtataatcaaaagtgtagaaaaaactagaaaaaaagttttagaacaacacgagtttacctagtatagactttctgccttatggtaatacctcctrtctctcttagccttttgaacagcccagctctcattgtgctagccttgagtctgaggccccatggagttcccatagtggggaaattctcaatcctcccttgctcccaaacaggcctctcctttgcggataggtcctggtgtgtttcttcacctcaggcctctttaagcctgaagaagcgtgggccctacatctgcttttagttttcagtcccttgtggtaagttggctaaggccctttcgcctctgttggtaaggaggggttttttgggcctccagaacctcccacaggtgctgtgtcttcctgttggctcattccgaggaggactcaccagctgactgtcaaactgggtcttcctcaccttggttcactgttggccatgtggacttcagtaggggctgccatccttctaagaagctatgcgattgtgtctatttccttctctggacagcaggagacccctttttgaagacagcacattttctttttttcttcttttttttcttttttttgacatggtgtctcattctgttgcccaggctggagtacaatggtgtcatctcggctcactgcaacctccgcctcctgggttcaagcgattctcctgccttagccccctgagtggctgggactacaggcctgcaccaccatacccagctatttttgtatttttagtagagacagggtttcaccatgtggsccaggctcrtgttgaactcctgacctcaagtgatccacctgyctcggsctcccacaktgctgggattacagkwrtgagccaccacgcccggccagcactacactttctaatgagtttttattgaaaaaaattttagttgaaaatgaagctgttggctcgtaagtgaaaagcttgaaggcaggctggaatcaggcatggctggaattgggcatggctggttgtaggggctctgctctttcctctcctcctgtgatggctgcctcctggtgttccacaaggtggcaggatgctccagtgctctgtcctgactcccagcctccagggttctagtccagggaagaggaccagcatctccttctgggagctcctgtataaatcctgtaatccattttttctcttctttctcttttctaatatgccattttattttttaataagttgtatattttagttcaaaaaatggaaagtattttaaaaagattatgaggtaaagagtttcttccatcctgtcccttttactattataaaaacacccttcattgtcctgttttaatggtttttattcgaattttatttttcctggtaataagatttgatctcatactttctttttatttgtattcacctaatatatacctctaggcagttgttgtttttcagccatctttttaatttgtaacctttctgaattactttgttttggattgcactcctatttgtagcatagaattttggggtttttttcccctctgtgatccaatctgaatttaattttcttttaataggtgaatttagccctttaatatgtcagatatatttgatttagtttatactattttgtgttatattttctatttttatatcttttaaataatctttcacgatgtgatctgttttctttgcatcttttttttttgttggttttgtcctggtggttggttttagaattataatttcaaataatgcccttagtcttctaagaaagtggtggttgttccctactgtgagcactgataaaattaaygagtttcatagtaattctaatatggagatattaaagccaggttaccttgtctgtcctactcagtcaagaaccctgtttcattctgtcttcagaggagagaatgaattactcggcttggaactcatcagtgctattattaccaatgagttcactgtcagagggggccttgtaagttttcccagaggatactgtccacctttaacaaggctctttttgtctatgagtttctaaagtcggtatagatcatgcaattggtaagctgacatttgtttgttcacagttgaacattagttcagagtctctgttggtggtctgttatttgatgccagagagtcaccagttttatttccaagcagacattaaaagatattattggttctgaagttcccttgttttaatgtgggctcaacacttgctgagagagcatttagtttttcaaaagcaatatggtaggcaacagagaggcatgttacatgtgaaaaggatttcttttttttaaaattagaagctttaatttaaccgtctagcttggcatgccctgtgtaatgactgagagaccgagatgactgtcttgttgtgagtcccaccaacaaggacagaagggaggttgccaccttgggaggagcacatcttctgttcatgctcctctccattcaggaggcttcagccccacagcacaaatagcctctgtagcggtcaagggaatgtggttttataattttttagatctgggtcaattatataatcatagataacttaatttttttgatgcagtggtatttactgtccacctctaataaagcaggtgaatcatagactaccattgkatacatgtctttggagcagatttccatccatttttactccagtcctatggtggctaccggtattgttcttgtcgcctgctattcttagtctgcagtttgcctgtgactcaccccaggaaacctgttgaaaatgctcgctctcctctaacttcctgctgaattcagatttagcacctttcgggtgggaatctgtacttctttgcaggtgactctgatgccggtgtcccacagactacagtttgaggaaatcaagactgacagttctgcaaggtttattaccctttaatttttcaaaaaataccttcagcaacagagaggcatgttacatatgaaaaggttaaagtagaaattttcctaaaatctatgtgacagaattctggtaggatgctaggcatgtgtgcagaatttcaaatagacttttttttttttttttttttttttgagatggagtctcactctgtcacccaggctagagtgtggtggtgcaatcttggctcactgtaacctccgcctcccgggttcaagcgattctcctgcctcagcctcccgagtagctaggattataggtgcccaccatcacactcggctcatttttgtatttttagtagagacagggtttcaccatgttggccaggtaggtctggaactcctgacctcaggtgatccgccctcctgagcctcccaaagtgctgagattacaggtatgagccaccacgtctggcccaaatagacttttgtttcagagatacagtgatttgaatttatcataacgttctttaattaagaaatccaggaaaatagagataggagattttataactttaaccagtttgaaaaaatatttatgtgaagatggtttaatatacagattgcagaacgatgaatttaacattcttgtaaagcttccaggaaagcctcaaggataagtgacaagtccatttttatcaaacttaatgggtttctaaatccttatctgcttatcaaacaaaattttaattagaactgtaattgagtaaccagctgcctcttgtgttcactctaggaacttgtctaaaaacattgtggagctcatgtaaggtcattcgtttttgagttgctaaataaactttattgcagacttctaaaaatccaggtattgaggaagtctacaggaagataaaaattgataagaactttgcagtagttagtccgatactctctctctctagtggattaaggtagaaaaatccttcttcagcaccacagatgggagaatatcctccctcttaggtttcttcctgaatcagcttatgcctgcctaggcttgtagtagaacagataaagcctttggacctagctactcttggtttgaatatctgttaatctgttatctcttcattactttggacattgtacttaatgtctcaagttcaatttactcatttttaaaatgggaataatgccgcccacagcaaggagagccgtagttctggaacttgtactcattcattcctttattcagcactactttataggttgagtacctgttttatactaggcactgttccaggcattgaatacagcagaaataacactgacaaaagttcccatcctcatggatcctagtgagcagagccatttcacaccaggtgatcggggaaagtttcactgagatgatgacttgaatggagacctgaggaaggtgagggagtcagatcaccataaaaaattactttttaacattattattatttttctttactattttctgcttaatcctactagaaagtaagctctatgacagtggtgggtggggggtggtatttgttttgttagagaattttagatgtgctctgttgtattagtttgttcttgcactgctataaagaactacctgagactgggtaatttataaagaaaagaggtttaattggttcagggttccataggctgcacaggaagcatggctggggaggcctcaggaaacttacartcgtggcagaaggtgaaggggaagcaggcaagtcctacatggctggagcaggaggaagagagagggggaggtgccatacactttcaaacaaccagatctcatgagaactcactcactatcacaagaacagcaagggggaagtccactcccatgatccagtcacctcccaccaggtccctgctccagcactggggattacaatttgatacgagatttgggcagggacacaaattccaaccatatcatatatggaagcacttttcctgatcacagaaatggggagctattgaaggagtcagagggcaagtgcaatgtcttcatctttagtgctctctctggcagcagtgtggtacaagggcttgaggggtaacgtgcagtaggcactccataaatgtctgctaagcatttttaaaagtgatcattctgccattcactatgagccataagagtagctggtagaaatgcctgtgaatgtttaaaagcattatatagactctatttcagaattgtgttgactaataaaaaatgctagttttccctaccccacacctatctttcaactgctttrtatttatttctttattagatagaaaattcctcagtaaacttttatttagagtaattcctctttatgatttttttgttctaaaggtcgattcttaaaagaaaacttgttgaagtgctctaaatggaagtctttttttttatttctctcctgtgtcttttatgatagtatctgacaactatmttttttttgtttttgcagagattgggttttgctctgttgccaggcttgtctcaaactcctggcctcaagcgatcctcctgccacagcctcctgagtagctgtgattacgggtgtgagccactgtgcctaacaccttttttgagaaacttatatttttttacatatttattcttgattcataatatttatacatatttatggggtacatgtgatattttcatatgtgtatacaatgtataattataaaatcaggtgtttaggatacctgtcacctcagacacaacatttctttatgtcagacatttaatatcttctagctattttgaaatatatgataaactattgataactgtagtcctaccctactgtgctatcaaacactagaacttattccttctatctaactgtatgcttgtacccattaaccagcttctcattacctccctccccaaagctctggtaaccattattctacctctatgagatcaacttttttagctcccacatttgagtgagaacatgtgatattcgtcttttggtacctggcttattttacctaacataatgacctcagttccrtccatgttactgcaaaggacagggtttcattttttggggggsgctgaatagtattccattgtgtgtatattccacattttcattatctgttcatccattgatggacacttaggctgagtccataacttggctgttgagaatagtgctgcagtaaatgtaagaatgcagatatctttttgacatactgagtttgtttcctttgaatgtatacccagtagtgagattgctggatcatgtaatagttctatttttattataaaaaattcttttaagagagggtgtcttgccctgtcacccaggctggaatgcgatggcataatcatagctcgttgcagcctggaactgcttggttcaagagatccttcccacctcagccgcctgagtagctgggactacaagtgcactccaccatgcccagctaatttatattattttttttagagacaggctatgttgcctaggctggtctcaaactcctggcctcaagctttagcttcccaagtagttgggtctataggtgtgagccatcctgcccagctagtaggtctattttaagttttttaaggaacctccatactattttctataagggctgtctcagtttacattcccaccaacagttatgtaagagttcacgcctctctgtgtcctgaccaacactttttgtctttgtgacaatagccattctaacaggaatgaggtaaatatgtcattgtggttttgatttgtattttcctgatgattaatgagagcattttttttttcatatattggccattctttcagggcctttgcccatttttaaatttggttatttgtgtttttggtattgggttgtttgagtttcctatatcaaaatacttctaaattcagcgtgatgatggaacattggtagttgcttatgagataaaacagactcttggattaaagtaaaaagtaaaagtttcagaagtaatttaattttcggagaagccagtaaaattggaatcatttgtgttttatttgaaaaaattaaaatrtggtacaaatataagaatataatacagatatagaagaaggctgctgaaaccaccatctagtccaggatatagagttttggcagtcactctagaagctctctctgcctcctcactgtcatagccctcagaggaatcatgatcctgactttgtcattgttatcaccttcttaatttcctttgcagttttgtcacccaagtatgtatccttatggtttaattttgccagtttattttttaaatgtcttcaaaatttttaaaatttatatttttagagacaaaggtcttgctatgttgcgcaggtgagttgggaactcctgggctcaagtgatcccccttctcagctccctgagtagctgggactacaggtgcataccactgtgtctgactttttataaaaatacgttttaaacctctttatctacaggttccctctccatctctttttattcctatcctcacctttggttttttttttttttttttgaagaaactcagttgtttttcttgtggagttttccaaagtctggattttgctgattacatatccatagagtttaagatattcctctgtattttctgtaaattggtagttgaattgagaggcttaataaaattcaggttttttttttttcatagaagaggaagagaactttgtagattctattttttcattgggaggcatataattatctctctttttgtgaattgagtagccattgatactcagtagtgatgaacaagtcttgctttttaaagtatcattatgaacccaagggcctaatgtattttggcttcattgcagttgttattcttcccagtgctcaaaatggcccattattgggcaaagagagtctctccaagttgacctctgtgccattttgccatgatgctagtaatctttagtagcttttttgtgtaacaagttagtctaggatcatcttaaacattttcagtcccagacctggaattagtcatttctccagtaatccttccctagtttcttttagtaggaaatggtatttttttttttttttctgagacggagtcttactctgtcgccaggctggagtacagtggtgcgatctcggctcagtgcaacccccgcctcccaggttcaagcgattctcctgcctcagccgcctgaatagctgggactacaggcgcgtgccaccacacccagctaatttttatatttttagtagagatggggtttcatcgtgttggccaggaaggtctcaatctcttgacctcgtgatccacccacctcggcctcccaaagtgctgggattacaggcatgagccactgtacccggccaggaaatggtatttctaaaccacattctgtgcaactagggaggctatttattggataggtcaaactatattaagaactcattaaaaaatacttctgattcaaattcagggctaaagagtttttatttaactttttcagtctgacatctatatctccttttccccaccatgtcgacaatcctggttcttatgtaagtactctgattttatcattcaaatatcaggtatttaatttgctttatcccacattactgaatctatgttattaaaattatatattataaaatgccattgcatttaaaggtcttacgtttcttccccatttatttcacagttgtaatatatctgcatcatcagagcatatagccattaggtactataccttctttcttatagcctccattgagagtcttagttctccaaacaaatatgtattacatgctcaccaccaattcttatatccatgtctttctagtcattttggttgtctgaaatttattctgtagtatggttgttcttacaccttagtgtgcatcagaattacctggcaggcttgttaaagcgccgagtactgggcctcactggcaggttctctggctcagtacatgtgggatggggcctgagaatctgtgtttctaacaagtccccaggtggtggtgatgctactggtctggtgaccatactttgggtatagctctctgtggcctttatacatggaagattggctaagcttaaaattcctggcttacagtttatttctttgagtatcttaaatacattactctattgtctgtagggtaaaacattgcggttaaagtttggcaactctgtttttctttcttttataaacaacttgtcattttggctggaaataattttactagattacttactgtgatggtcattatgggttgatttccccaggtatgtgatgtgttttttaaatatacagtgtcaagtgatttttctgtttctttgctttgccctctttgccaactttgtaccttgggggcaccttttatacacgttttaggtcttctttgccaaccttttgtatttgttactttctttcaatctttcaaatctcctctttcatttctttttgactttgaaaaaaatttccccctttcatttcctgcttcttatctttattatctgtagtattkattcagttgtgtgccttctagactatcgttcattctgagaagttttccttttgtctctaattcctgagttctgcccgttgatttctgagtttttctaaatccaatttgttttcttaataatttttttaacttgttagggttttcatgttttatggagatatctaacatgattctgttgtctgtagagatgttattatgttttttctttttttttcttatcataactttggacaggatttgagttgggtccttttctattactcatttttatgcaaattcattttcccaaacttttagaagaggcatgggttcaaaatagcttttctgacttcacagttctggtagtgttttttaactccaagtattatttataaacagttcatttttaagtgtacagtttacacaactgtaagtgtaagtggtagttttacacaattttgtaaccactatcacagtcgagatgtggaagaatacttttaccctaaaactttccatgtgcttttgcagttggtcccctcccttcacatctggccctaggcaattaytaattttccaccagtatattttaccttttacagaatttcaaatacaggatatcttacaatatatattaaaattttttggcttgatttctttcacaaaatatgattttttgaggttcattttgctgcatattgtcaaagtatttgaaaatgtgacagctcattttctcctggctctgttctgtagtacttttgtctttttaacaattaccctgttatccttttctccccattttagattctgttcataggagtttttcctcagggtaagatttgtcctaaaaaagtgctttgcatcactggttttgtgaattcatagggcctagagttctcaagccccttcaggctttactgtggactccttgtagtcactattatcaaatatacaaactgcactcccaatttcagctcctcaaaatgtcctactgtgctttccagtgagtacctcgttgctgttttgtgttgtttctgttttccgattgttagagttctgttgcttttgtctgcttcttctcacatggttgctgatagcatttgtatcttattgttcatcccacctgcttgcattttggggttcttaatatcttgagatgcagttatagtgtagtacatgttatctgtgggttttagtttggttattaaagtctctttttatggcaggatttagggagactgaaaaactatgcttgaatctaacaaaaaacaacaattatttcaataaaatattatatcaaggaaaatagcaaaaaattacaaatgtgtgttacattgataaaatgatacatttatttctacttttcataatattgagggagggagtgttctgcttttgtgacgaggtatagccatttgtgtttctgtgttttctgtatcttttacatatgtctaccacattactgtctgttgtcttagattgtaaactaagaaacagtgattgttgtgtggcatatgcccatgagaatttgtttaactgtttttgtgaagaaaaaaaatatataaactatagattttctgtcataaatccttctttctgaattttaacctaattgtaaagcaaaataggtaataaagtttcactattgtttatttattacaaggcattgtaattgaacttttaaatcaactcatacgatctccttgctcaggaaggaaaatcataaaaatagaaaaaagcttgctttattttggtgctggggatggtttcaagtcttttttcagttttatgtagagaccaagaaagtgttctgcatagggagccaaagaaaaaaatattgagaaactttctaaagtatcttaactcagttgtttatagtatagctttactttacagataacttttgatgttcttagatcattagatatacctacatcartatacataagataagcttccaaaggaaatactctttgctttgggaatactctttcctatcatctactaattttcattatagcagcagtcttttatttgtataggtcagtggttctttaactttaatgtgcagtagagtcccctgatgctgggccgggccccacccaacacctgttcctgtttcagataaagaccagagagaggtatgtgtacgtatctaagagtgagcacaaccaaagctgtataaaaccttcatggaggaaattacagaacattactgttggatataatagacatgaatagaagaatataccagctttgataatgtgatacctctatttaagatgttatttctctctaaattaattcattacatatcaaattaaaataccaataagggctgggcgcaatggctcacgcccataatcccagcactttgggaggccgaggtgggcagatcgcttgagtccaggagtttgacaccagcctgggcaacatggcgaaaccctgtatctactaaaaatacaaaaaaattagctgggcgtggtaatgcctatctgtagtcctagctacttggggctgatgaaggaggattgcttcagcctgggaggtcgatgatgctgcaatgagccctggtccagcctaggcgacggagtgaaactctgtctaaaaataaataaataaataaataaataaataaagtaatcccagtaagtttcttgtgaagaccgaaggtaagtgaacctaaaattcacaaagaaaatcaaagggccaggagtagccaagacaatcttgaagagcaaggtagggaccttgccactttagatatagatgccaagccctagaaattaagagactgtggtcgtgatacagagatagacaaaaagaccagtggaacagcatggagaatccaaaaacatrtatagaaatgcaatatgcagtgaaagtaacattataaatcatcagggacgtatggaatgctaattgctgctttgatcattaattatatggaaaatgaaattgtatttataacttcacactatccacaaagataaattctggtgaataaattcagaaagcagatcttaaatttattagaaaatataagaaataataaaatacttagctgctgttaaaatgtaaaaagcacatgtatcttcatgtataaatcttagaaatagtgtaacattgaggataaaatcaatttgtatggttatgataaagtaccactcatacaaaatgaaaagcatgaaatgatacagttttttataaaacatgaaaacatgcatggtaatatacatcacattcaagataatgtttgcttcttttattaattttttttttaatttgagacgatgtttcactcttgctcaggctggagtgcagtggtgtgatcacagctcattgcagccttgactccctgggctcaagtgatcctcccacctcagccttccaagtagctgggactacaggcatgtgctaccgtgcctggctaatttttgtattttttgtagagagagccatgttgcccaggctggtcttaaactcctgagctcaggcagtcctcctgcctcggcctcccaaagtgctgggattacaggcattaagccaccgtgcccggccagcgtttccttctggaaatcgtagagggatgtgattagtgagggatatgtgcaggctacaactgtaactaaagttttatatttttaaataaaaatgttttaaagcaacatgtgacaaaacattaacaccaaatgaatatcaaacaacaaagaaatagttgaagaaattgtggcatctatatactatgaaatatttttcagccattaaaaagaaggagttgtagctaggtcatttttatggagggactttcaagaattattaagtgaagagaacaagacacagaaatatgtttataaaatcatctcagttttataatgtagtaatataatatataatgagcatatattatatatgcttgtgtatgaccaaaatatgaacatgaaaaaatatggaaagattcattctaggctgttaacatgagagataacagtcatgggagtgagatgataaagaaagaagagaaggaggacagaatagggagtcaaaaaacatagaaaaagaaaatgcattacccagcatgcatgctatgattttgtttatgtacttaggcaaatttttatacatatttttaggaggactgtagaatcactttaaagagtgagagttaacctaatttactatatttgactggagactgtgatagaaacagatttagcagaaagtccctcaaagaaagagttactcagtgctgtattctgttgctagattatttaaacaaataacgtaatcaaatcaaaatgatgcttttcagtttttctctcttcatatttagtaacataatggaccctaatttcaatgagtttttctttttaaataatgatagatataaaatactcacaatgtgctaggtgatataaaatagcagttaataaaaagtacttggccaggcgcagtggctcacgcctgtaatcccagcactttgggaggccgaggtgggcggatcacaatgtcaggagatcgagaccatcctggctaacacggtgaaaccccctctctactaaaaatacaaaaaattagctgggcgtgatggcgggcacctgtagcttcagctactcgggaggctgaggcaggagaatgatgtgaacccaggaggtggagcttgcagtgagctgagattgctgccactgcactccagcctgggcaacagagcgagactccatctcaaaaaaaaaaaaaaaaaagataataaaaaaattaaaaagtactcattttaatattttatgaaatagagcattttggcagagaaactttagctctttctttctctctctttcttcaacttgggaaagaataaggmataaatctttatcttttttttttcytcttctggccaagacctaaataccagcatttcatgataatggataagttatctttgaaattttccttttttctttcagtgtgcaggatgacagaattcgagtcgaaaggatggataacatttattttgaatrcagccatgctttccaggcagttacagagttttatgcaaaagatacagttgacatcaaaggtaaatattttcccygtatgtcctcaagttgaactgatttgaaatttggataaaggtattmgtatgattctcaatttaatgatgactaggtagttattataaatatgtgggagaagaagagctcactgttgttgtgctcatcagaaacactattgtactgcagtcccagctactggttagactgaggtaggggaggatcgcctgagcccaggagttmgaggcagcaatgagctattatcatgccattgcagtccagccggggcaacaaagcgagatcctgtctgttaaaaaacaaaaagaaccattgcagcctcttttgaaattatgaccagctagtaagttgatggttttgacatattcatcagagtggaaggagttttgaccatctttcctttttgcttatctttaaagatggctcattagtatctttgtattttatagactgtttggatgataaatattctgatgaagactagcattttgaaaggttggttgccaaaattaaaacaccagaatctagtgacaggtcgaaatattttaggtaatcattatttgtctaattcacatgtccacaatcaggcattaatgtttactttcatttgtacctcacattcctgccagtccagcttatgttagggtccattttgtggatggtgaggtgaatagacattttccctcttggcataaacttggcttcactctaatcttcatcctactccatatggaggaaatttatctctgtcacatgctagagagtgttcatcatcagctccccatcactgctccatttaagcatcagtgtctagttagcatttccttgcatctaggcatcagtgtcttgttagcatgtctctttaatttcatgatgccttggtcaaataaagtgtctgagcgtgtatcccacttctttttatttttttctrtaaggtctcactctgtcacccaggccggagtacagtggtgcaatcttagcccactgcaacctctgtctcttggactcaagcagtcctcccacgtcagcctcccaagtagctgagactacaggcgtgcgccaccacacccagctaatttttgtattttttttgtagaggtggggttttgccatgttgcctaggctggtcttgaactcctgggctcaaacgatcctcccacctcagtctgccaaagttgctgggattacaggcatgagccactgcgcccagccaagtgtatcccacttctaacaccagtgttcagtattaccgagaggtcatcttatgttcaactaaagacctgataaatcttaagactaccatgacctatccgtggtaccagatttacttaaaagatatgggccagaaaacacaccttacaagcagagcatgtgttgctcttagtgggatagtcctcacagcagactttgtggcagtgcccgggagagtgtatgaaggaaggagactcacatcaagtgagcgtaagcgccaccctggcttagaagctccaggcccttgaggagcctgtatttcttgctgcagtctctacaaaagacacgccagttgacaaaagtcaacgcactaagggaaggccaaaactctgtagtcaggtatttataattcttctcagtccagatgtaatttactgatatttggtcatttttaccacaggcagtgctacttctaacacattgatacaccatctttgtcatgttttctggggaagaaagctagaaagttaaaagaaaatcaatttctcagtggaacggaaaggtgttgttagcacttcatttacactctggttttataaacacctatagttaaaattaataagatattttactgatttgtagagaacatcttgtaatatatgtttttttacttctaaaagtaattaatgcttattgcaagaaagtcaaacagtgtagtcgtatataaggaaaaaagtaaagtgcctgccctcaaacttgtcctctgcccttgcagcttatatgtcggaggggttatcattaacaatttggcatatatccttgtgtaaaactccacacatacacacataaacatacacatatagtwctctgtatttgtttaacataactgggatttattcgttcagctaattttttgaatgcctattatatgccaggcattgggcatacaataaggaataaaacagacaaaaattcctgctcttttggagtttacattctaatggtgagagatgtacaataaagtaaactagtgtgttagaaggtgataagtgctatgaaaaaaataaggcaggggagtgggttgaacttttaaataggatggtaaaggaaggcctcactgagaaacagcacttgaacgaagatttgaatagagactgaaggagttaaggaaaagagccatatagacatatgaaggaacagtatttcaagcagagacaacagtaagtacaaaatatcttaagtaggagagtgcttggcatgtttaaggaatagcaagtagtctgtgtgctggaacagagtaactgatggggagaacattaggtgagctcagaaataaagaggagatggcaggcagtatagggtcactttaagggctttgacctctactcttaatgagttgggggatgttggaggacttttgagcaaaatagtctaatgatctgatatacattttaaaaagaattcctctggctgctctgttaagaataccctgtagggtgcaaggatgaarcagtgagaccagatggaaagctgttgcagtgtttgtggtgagacatgaaattgatcagacaacttttttccctcacttagcaacatgttatagatggccttccatatcagtgcagataattggaagtcattccatttagttggtacataataaccaggatttacccaactttatttaagtactacgctgttaatgtttatttaggtggtctctagtttttttttaatactccaaaagatgttttaagtcaccttctggtacacacatccttgacatgcagtttggagtatttctagacaaaggggatgggcattttacattttgaaaaaacaacctgttcttcaaaaaaggttcatyccaccatcagaaaaatgccctttttttccatgccctgggtattagtaatgatttacatttttccaaaggtcaattttaggagatattgtccaaattattattttggtaaccattaagttttacttaaaatttgtgtttaataatgctaacaagttaatggttctgtttattacrttttttaatttgattaatttaaaagaatttttataacaagttaatatattctgttttctaggttctcaaattatttctggcattgttaacttagagaagcctgtgatttgctctttggctgccatcataaaatacctcaaagaattcaacttggaaaagatgctctccaaacctragtaagtgattcctccaaaattaaaaaaagggggagcttatattatgaacatttcttaaattgaatttggtagtactatacttagagaagcttgcctgctattgatagaatactagggtgcaaggatgagctgtttggtattgttgctgaagaatattaaaaatatattggctgggcacggtggctcatgcctgtaatcccagcactttgggaggccgaggcgggcagatcatgaggtcaggagatcgagaccatcctggctaacatggtgaaaccccgtctctactaaaaatacaaaaaattagccgggcgtggtggtgggcgcctgtagtcccagctactagggaggctgagacaggagaatggcgtgaacccagggaggtggagcctgcagtcagcccagatcccaccactgcactccagcctgggcgacagcgagactccgtcccaaaaaaaaaaaaaaaaatgtgtgtgtgtktgtgtgtgtgtgtgtgtgtatatatatatatatatataaagaattctgtcaaataaattgtattcatgatagctatttgatatattatagttttgactacaaaactgtgctttatactaactggacccagaaatagtattaaaaagcattcataaaaatttaccacctttcttattcttggtttcagttcttatttcatagaccatgaagttagagataaaagggccagctgctaacacagctttttacaagagtgattaactgtggattttggaaatttaaaagctcacaattgacattctaggaaaatactagtttgataaccattggaatagaaaaaagtagtagggtactttccttgtctttttatattccgccttcaccagccccttgtctttgggtctgtcaagaatcaccctccattatattgatccagggtgcatcagctctgtcccattctgcacaagtgggaggggagataggtgctatctcagcaaaatgacagaatagaaattaactaggaaacaaggaggtggtgctggttcaaggttgctggagagagtcaaagaaaggcaggttccttggggttctttttgtaatgtctttgatgtgcgttctcccgtgtggtactagaacagagtatcatttctctggaagcaactttatcctatttaaaagcaatctaaatgcccatcagggatccttgtgctatattcatgcaatgtaatgttatatagcagtgaaaatgaatgaactagagctattaatatatgaccaatgcttaaaatttcatgaacagtatattaagccaaaaataaagttgctgaaggccacgtagtacataccattatatgaagttagaaacatgtgaaatcgtactctgtactgcttaagaatatatatgtagttagagaataagtgaagacatgcaggggagtgatagaaaattcagaagcagggtttcttccagggggaagaagggaaagtagtaaaggttggggatggaygtggcatagtggagttctaactgatgtttcatttctgaatgtgggtattgtattaatctatacattttttagtgtggccaaaatgttttattttaaaaagtgtcagccyggcattataccctcattggattctactttaagctccaaaaataaacttattaaagagatcaatctgtatggttggttgtgttggggctttgtaaaaaaaggggtgacaagatacctaccagtttgacttgttcatgatagggaccctgtaagtgaggtacaattagtgataaatagcttgcccattaagacttgtgtttgtgttcctgtatcaccaagcaaagaagtattaatgttgggataaggaaactaacttagaaatcaggccctgatgtgtttagaagcaaatgaatttggacctggaaagatgtgtcctcctcatatatatatatatatatatattttttttttttctttttttttttttagatggagtcttgttctgttgcccaggctggagtatagtggtgcgatctcagctcactgcaacttccgcctcctgggttcaagcaattctcctgcctccacctcccaagtagctgggattacaggtgcacgccaccgcgcccagctaattttttgtatttttagtagagacagggtttcaccatgttggccaggctggtcttaaactcctggcctcaagtgatctgcccrcttggcctcccaaagtgctgggattacaggtgtgagccaccgtgtccggcctgtcttcctcatatttaattcgaaataagaataataccaaacaataaaacaagatgtctatatatactgaaattaaaatagattcttttcaaattacctgaagtaacctcttgataaactgaagctgaactttttgcatctcataattgatggtggaggatggtcaggaaactggctctgctagtgacttagtgtatcatctaatctacctgttgggtacttccatggagccaaagccaaaagacataaagtgctctgctttgtatatattcccagcatccagcataagcccagcacctagtaggcttttattatatattattatatatagtattaatataggattaatgaaagaaggaaggaattcttcattctgtgagggtatatttcattggaaattgccaaaaggtcattggaaaccaagattaataaagatagtgatcaaactggtactctagttttgcttaaaaacgaaatgtggtgttcatgagtggcatgtaatttgaagatcattctaaaagagtaattctgtagtgcttatattttgcaaaaataatgttgcttcttaaggtgattactttggaaaaatgaatattctccttgtagatgaaaaattcagttgcattattttataaacatactttatgctgctgaagttttggacttttatttacaaagctatgttatcaaggggaaaataaatttcacttgagttgacttgtttagtaaatgctttcacaaacgttgctgcatatttcataaaaatcatgatatacgtttatttaaaggtccttgtgccattagaatakaattttagatagtttgagaaaatataccatttcagaaattattcttaaggatgatttaagtgaagttttgttaagacacacttgaggttctaaagttattttgagagtttaagtttgtttcaaagaaaaatagtgtaacaaaataaatagaatgtgagggatattatttattataacagaattaacctgatgcctaaatttatgaaattcagaggaatccactttttgttgttagaaatgaatgcttttgtcattttggatggtttttattaagattggagtggtcacaacttcaaaaagatattggaaattttaggaaagagtgagaaaatccacccaagataaactgtaaaaccttttttttaaaagaaaacttcttatgataacagaatgataacatgtggtgattacctttacttactagtgaaagaaatagcttaatatataagctactctcatgacatctaatgkctagcagccagggatgctgctaaacatcctaaaatgcacaggatatttccctaaaaaacacattatttggctccaaatttcaacactccaaaaccaaacaaatatattacaggaaaagaaactacagaccagtatcttttgattataggcacaaaaatcctcaatgaaatataagtacatggaatcaggaatataaaaacgattgtactccatgactattggatttatttcgggtatactggcttggtttaaaaatctggaagccaatcaatgtaatctaccttatcaaaaactacatgatagtctcaatagacaggaaaaactctgcataagattcaacaccccttcatgataaaaaacgctcaaaaaactacaactaacgtggaactttcttgacctgacaaaggacatttatgaaaacctcacagacattaaacctgtctgttgttgttaagatgcagtattgctcagatcagtctctaagttcagtgcaatttgtatcaaatcccagctggcttccttggagaaattgacaagctgatcctaaaattcataggattcatatctctgtttcaaaacttactacaaagtgagtaatcaagacagtgtggagggtgggattaaaaaaagacagtgtggaattggcataagcacagacatgtgatcaatgtgatagaattcagagtctggaaataaacttatggtcatttgattactgacaggggtgttaagacaattcagtggagaaagaatagatttttttcaaacaaatggtgccaagataactgtctgtgcaagagaatgaagttggacccttacttcatgtcatatttgagtttggaagataaaatggaccaaagacctgatatgagttaacactgttatactcttagaagaaaacataggtgtaaatctttgtaaccttgaatgaggcaatgatttcttaactatgacatcaaaarcacaagtgagaaaagcaaaaatagatacattggacttcatcaaagtaaaagcttttattcttcaaagaacaccatcaagaaagtgaaaagacaatccactgaatagaagaatttttgtaaatcatatatccagtaagggacttgyatctagaatatatatatatatataaactcttacaagtcaatggtaaaaagataactcagaaaatggacaaatgatccatacaggtttttctccaaaggatatatgcaaacaaccaagaagcacgtgaaaatatgctcaacatcattaagcatcaggtaaattcaaatcaatgccacagttagataacacttcatactcactaggatggctataactaggaaaaaaaaaggtgttggctgggatgcagacaacttgaaatcctcatacattgccaataggactataaaatggtacagccattttggaaaacagtctggtagtacctcatgacattcactgtgtgatccagcaattccactagatgttacttaagacaaggaaaatatgatgtccacataaaaacttatacaaatgttcataagagcattagtcacaatagccaaaaagtagaaacaactctaatgtccatcaactgaagaatggatacctaaaatgtgttatatgcatacaatagaagatttttcaaccataaaaaggaatgaagtacagatacatgttgcaacatgatgaaccttgaaaatattatggtagttgaaagacatcagtcacaaaaagtctcgttttgtctgattccatttatatgaaatgtccagaataggcaaatccatagagagaaagtagattagtggttgcctagggctcttgggttgttggggggaatggagagtgattgctaatgagtatagagtttctttttggagtgatagtatctagaattacatggtggtgatggttggccaattttaatatactaaataccacttaattgcacactccaagtgggtgaattgcatagtgtgtgaattatatcaataaagttgatagacacatacacacttatcttttaaatgtcagtagtgctgagattgaaaaatctttgtctctgtctattttaattctgttcttaaggcaatatccttctgaggcttataaccaatgcctcatgtattttgaggtatttctactctggttggagagtgttccaagccctttgtgaactctggtcactgttcactactattttctggtagttatttccatggtcccacagaggtccctaaacgcctttgaggactggtacttggccaagagttgaggtgacccttcagcagatctctggagctgtatgtgcagctctgttatctggcattctgtctcacaaattctagtttccctgcgcccaccaaagaggcagtcatgttgtttacctcatttgtttttcctctctcagggtcacggttctgcaccaagtgttgtccaatacctgagaagttttccccctcatgtgttttgtccagttttcttattgtttatgattggaggacatttctcatgcagttacttttttatgaatgaaagcagaggtcaggtggcacaattgaacactgcacagaaagaagagaagagggaggctggagaaaaacattctatgaagtttaaaacatgattaccggccaggtgtggtggcttatgcctgtaatctcagcactttgggagggtgaggtgggcagatcacctgaggtcaggaattcgagaccagccttgccaacatggcgaaaccccgtctctactgaaaatacaaaaattagccgggcatggtggcaggtgcctgtaatcctagctacttgggaggctgaggcaggagaatggcatgaacctaggaggcggaggttccagtgagccaagatcatgccactgcactccagcctcggtgacagtgagacttcatctcaaaaaaaaaaaaaaaaaaaaaagttgagcacagtggctcaacgcctgtaatcccagcgctttgggaggtcaaggccttcggattgcctgagatcaggagtccgagaccagcctgggtaacacgatgaaaccccatctctactaaaatacaaaaaaagcagccacactggtggcgggcacctgtagtcccagccactcactctggaggctgaggcaggagaattgcttgaacccaggaggtggaggttgcagtgagccgacatcgtaccactgcactcaagcctgggcgacagagcgagactccatctccaaaaaacaaaaccaaaaaagaacagaagagcgagatgtatgaagttagaaaaactgtcctaaaaattgcccgtgttctaaaacttcaggaaaattaatcttcacttaaaaattagcaatgggaaaagaaccaaattcaaatttcttacaaaattattatgagaaaaaagagaataaggagtaggatgtcattacagataatgtatacatgccagaaaatcatggtcacagattaaataaaaatgacaatctggctgggcgcagtggctcacgcctgtaatcccaacacttgtgggaggctgaggtgggcagatcacctgaggtcaggagttcaagaccagcctggccaacatggtgaaattccatctttccaaaaatacaaaaaattagctgggcatgatggcgggtgcctgtaatcccagctactcaggaggctgaggcgggagaattgcttgaaactgggaggcggaggttgcagtgagccgagatcgcrccattgcactccarcctgggtgactgagcgagactccgtccctcacccacccacccccctaaaaaagaaaaactactgttttaaaatgagctaaaagacactaagaaaatgatactagatgtgaaagaacataactaagaagtatgaaagattggaaatgaggtgataggatttaagacagaagtataaagaaaaagatcaatttaggactgaagcgtaaacttgaaagaacataatagcgaataaatgtaatacatatagttttagagtagaatttaaaaagagggatgtgcaaaaaattaacatagcaggcctaatcacaaagctttccttagaaaggccttcctgcaagcttggcccttgactggagtctgggaccttgaatttcgggagagttttcaccatttcgtgatgagagtggctcactgtgccttaactgtttgtgcacacagtgtggtttatgctgatcacctaccttcttggagctggaattttggtacatggtagggagatggtgcctatgggaccagtccggcatagaaaccatgggtgctgagtctctaatgagttccctggtggacagcatttcacacgtgttgttacaattcattgctggggaaatttaagtgcatcctgtgtgactccgcctggagaggattcttggatgcccggttccccctggactttgcctcaggcaccttttcctttgcctgattttgctttgcattctttcactgtagtaagtcatagctgttagtattactctatgtcgagtcctgtgtatataccatgagtcattgaacctggcagtggtcttgtagactcaacatacacctttcccattatttgcctttctaatgggcttattggcaggatttagaaatgcaaagttagtcatgttgtttaattacagatcaattataagtgaatctacaaccctgaagttttgtaatatagtacaatttatattttataaatcaaattaactgccaaaaagttagacaagtgatgaatttatgaactctgaaagctgtacacacagaaatgttttcagcaatagatttcatgtgttatatggtagtttttgtcattgtttccattttaaaatgatatttaaataagttctgtacccttgttgcctttgtctgtcttttttttaagcagggttagagtaatatggagttgatttctctgtccagcttttgacaaagatgtttccctcccactattgagggaaaaaaagcatctattgtatttttggtgtctgaaatattgataaaactattttcccatgttatatataagatttctatgcaggttcacaaagcatgaattctagccagatgttgttggtgagtttcatttcaaagcacatagaatttgtcttcttctacaatggtaaataatttagaattgcttgagtgtttcaggtcagtgatcggatactattggataccttaggatgctggtagatataacccttagttcaaaaatatatataattctaatggaaataggtgctaacagaaggaaattgcatttctattgggaaggaagactccaactccagaatacgtataaatttatacttataaatacttacgaaatatatgggaactccagaagcatggttagtccttgtagttgcttgataattattctagatgggaatcaatctgatttaagattgcccagtggttgatcttttattaaaatcaatgtagatatcagtttaaaaaaactcttagtgcatctgatttgaactttagattacttgtttagtaaggacaaaaagaaaaaacaaaaacacacacagcaaaaagaaaagacaaraacacccataaccaaccaaataaaaaaccacacacacaacacattaatacttacgttaataycattgattaaaataacctatacctttgctctctaaaggtctggggttgtgagctaacttaaaaaccagcttggttgttcacagttactggtttccttttgatattgcagatatttggtaattatatgtagatgaaggctgtaagccttctaccccaccccctgtataccaggtagtgggttaattcaaactgaattctgccactcatttagatactttttagcaagcaggcacaaaaacagtcatgtaaactcttctctagctctatgaaattacaattctgtctttttggtattccgacagtaccttgtttcagtggttcacttgaggcatgtgcaacattataatagggacagttcacttttagttggagtcagggaacaaaccctgagataattggtagaacaggggatgctttcagaatccgaagcctaaaacaccatcccttagggtatggactgttggatttataggattattataccctgttcatatgagggaggaggcaactgggcagtatttctggacagcccacaaactgccataccaccgtgaaaaattatgtcttacacatctgttgttgacagaagataaaggcagtgagctgagatgcttttaggaaaggctgctagattgtggtttcttgattagtctcatgccaactgttatggcctggatgtttgtgcccttcaaaattcacatgttgaaacctaatgactactgtggatatattaagaaggggccttttactaagtgattaggttatgagggcagatcgtttgtaaatgggattaatgcccttatattaatagaaaagacttaaaggaactgtttgtccctcctccatgtgaagacacacagaaggtgccatctatggggactgagccctcactagacaccaaatctgctggcaccttgattttggacttgacagcctccagaactctgagcaataaacttctgtttacaaactgcccattctgaggtattctgttataacccaaataaacaaagatgccagctaagcaccgttctagagtcgaygtctgattagggcactaacatgttaactagtcacccctaggatggacttagttaaacctaattgtcagaacagcggaagtaaggactcatatctaaacacataggtaactggttagataccaactcagagcccaggctatcagccaaacttccaacttagatctttgaccatgaattcatgtgaactcttgtcagctacatagccaatcactgcctaattgtttcttcctgtaaataatgttttacattttataactgtctggctatttcacagacatttctggagctttgtgattcaaagggaaaaatataaacccaacctggttttccctaggaagatggcagatatttgtagaccctctactgtctgctaagctgtacaggtggtacaaaatgattgccttcagggagcttagatctattaaggagggtagaggcacaacataaattgctgtaattcaagacaaattaagttaactgctaccagagggagagaaagggctgaacacttgctatcctttcagttttggagttgcttcccgctgaaaatcattaacagattatcgttctttggaagctagatcaaacctgtcacagatacattacactaccaaaggacagcattgagttactaggcaacgttcctaatttgaggtaaagtatttctcttttccagggctttggggccttagtcaaaggagtcatctagaagtgaaggaatctctttttgggtactggtttttcgggctctgatattaggttctctaaagttctgggtgagggcttgttttcttaactcgggaaactggwtgttacctaaatttcattatagctatgagaagggtggttaggtttatagcacaaacacttatgcctttcttttgttaaataatttagtgacctgctgttattttccttgcctttaaaaataagctctcaagcctgtaagggctgttgacagaaacatctaaggactggctgataaaggatattgaattactgcattagtactgcattgattagtacttcttaacacgaattggaattgtacatacatttattagtcatgctgtagctcattctcaaatctttttgaaatttattgaacttctaattttgttttggatagatactgagacaataaggagagtgtgaatgctttaactcagtttaaggaaataacagtgttttatacccactaaatttggccatggtaatgtgtgttttttttcttttctcttttttttttttttggagacggagtcacactctgtcacccgggctggagtgcagtggcacaatcttggctcactgcaacctccgcctcccgggttcaagcgattctcctgcctcagcctcctgagttgctgggactacaggcgtgcgccactacacccatctaatttttgtatttttagtagagacggggtttcatcatgttggttggccaggatggtctccatctcttgacctcgtgatccacccaccttggcctcccaaagtggtgggattacaggcgtgagccactrtgcctggccgcatgtgtgttgttaattacagagtaaataacacttgttgcatatgttagaatcttttttttttttttttgccgaggcgtagtctcactctgttgcccaggttggagtgcagtggcgtgatctcagctcactgcaatctccgcctccctggttcaagtgattcttgtgcttcagcctcccgagtacctgrgactacaggttcgtgccaccatgcctggctaatttttatgttttttagtagagacgaggttttgccgtgttggccaggctggtttcgaactcctcacctcaggtgatccgcctgcctcagcctcccaaagtgctgggattacaggtgtgagccactgcacctggcctagaatcttgattaaaagtatttatcaagatgatctcatgctaaagaataaggaggacagttttaagtatcttgacatatttttctagctgattacacagcttttcatgaagatgtggctactgtgcttggctaatgataaaagaccatgtttggttctattcctagagcaaaaccaaaacaaaatgttgttaccattacttccctttcctgttcttgttttttttttgttagagtaactatctttgtcttgcatcaatctacttaacagcaccagcgttaatggactacaacagcctgatgaattttcattttgctccttttgtttgattttctatcagaatgctaatttttgccataatgtagctggcatgtttctagttcctgaattagttttttatttctttatgcacttacatctaggctaattatatttgattcttttacaggaattttaaacagctatcaagtaaaatggaatttatgacaattaatggaacaacattaaggaatctggaaatcctacagaatcaggtcaggcaaatacaagggctagttgattataaatcgttttgggaaaaacttctgagtaaggcagcagtctgtttttagaggtacaggtgaaaatatagtgtcyttagctgactgcagtattaattgataactgtagctctttttggagaatgaactgtacataatatttctctgggttttttggggggaatgatggagctgccctttttaatgactgaggggcatgcttatcctgacaatttctgtaacatcatttctatatcatgtagttttttggaaaggcatcatcactgaaaatatgaagcggattttttttgtctacttggttatatttttctatacacctttagctttttcttgaaatgtttgcagtcttatttaattattcaggttataaaacaggtttctgggatattcagtttgactgtaagatgcataacatttcagtttgcaaactttctttttttttttttcttctttgagacagagtctcgctctgttgcccaggctgggttgagtgaagtgatgcgatattggctcactgcaacctctgcctcccaggttcaagcaattctcctgcctcagcctcctaagtagctgggattacaggcacctgccaccacgcctggctaatttttgtatttttagtagagacagggtttcgccatattggccaggctggtctcgaactgttgacctcaggtgatccacctgcctcggcctcccaaaatcctaggattacaggcgtaagcaaacgcacctggcctcagttcacaaactttcattgtttatttgtcctttgttgatgaattaggaagataacggggagattaaacttattgctttcatttattaaattatcacttgggaagatgagacattatattataaaattaatgttatcctaacaaagtaatagagataaaaagcaaccccacgtcatttgattaagtactggagaatcatctgaaccatctgagtcaaaggagttaaaactcttcagaaatatttattactattgcaaattaaagtaaacactgaatttattctcctgactcctgaatctgcatattrttaastagtttctctcagtttcttcctgttccagtctgttctagtatgctgaattcagatgtatttttgttcagtaacatttttatcttgtcatcatccaaaagctgagaatctgtcctgccggtctgtctcrtcaactctgtagccatctccatgataggaaataagtagtaggaataaagagacatttctcggctgaaggagtgctgatagcctgcagccagccctggcattgtaagcgttccctgcttctgccgcatcttccctgttcaaatcctactacaacagagtcagttctgaaatcaaattcctaaggcagaaatcatctggaatcaaaatacccttcaaaattccttcctttattggaccttgcaccattttagaagccgaagctgagattaacatcttctgcttgtctttgtacttcaacttcacccccaccgccccycgcccacctttccaaggagcaatggaaagaggtgcagggtaggagttgggtgtcagcaagaacaaggatataataggacaygtatctgtccctcctctcttgtctgagcctgcttctccaggggtgtcagggaattggcctcctcacgggaccctttaccccagtcaggccagtcaagctgtggtctcaggagcagtgctgctgctgatctgaactgccctccttagcctgtccagccatcctcagaggaacctttgtgaccttgtaccttctctgtgctctctccattgaactcctgaggcctgagagcttatgtcacaccttttctagttgattcctggcaggtggcattgtatcctaattacgagtctttttccaacttggctataagcaccctgagggtgggaccatgtccttgctatgttcagcacataggaggtactctggaagtagctacttacagaggagaaggaaaaaagaaaggattaaaaaaacccaactcaagtggaaacagccattttaggtctcaagatttaaatgtctcagtgggctttgtactactgtgaaaccttggttaaaattaattatgtctagttaattgtgatttttttttaaggacccaaattttaagtggcaaaagcaaacttttctaaggatttagtaaaacaaactaaaataaaatccttcctgggtaaatacctagagtgcagtgcaagttcatgtctatctccagcaccttgttcagtgttgtcatgagagcattggtttataaaatggtaactgtgaaataccaaaggaaaattaagtcatcttcctatgttgtatttcccaaggtaggaaagtatgcaattatattttaaagatgcttagataaagcatctttatcatttcaaaagaatttctgaataatttattctttggtaacnnnnnnnnnnnnnnnnnnnncagtgctgctgctgatctgaactgccctccttagcctgtccagccatcctcagaggaacctttgtgaccttgtaccttctctgtgctctctccattgaactcctgaggcctgagagcttatgtcacaccttttctagttgattcctggcaggtggcattgtatcctaattacgagtctttttccaacttggctataagcaccctgagggtgggaccatgtccttgctatgttcagcacataggaggtactctggaagtagctacttacagaggagaaggaaaaaagaaaggattaaaaaaacccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaacccaactcaagtggaaacagccattttaggtctcaagatttaaatgtctcagtgggctttgtactactgtgaaaccttggttaaaattaattatgtctagttaattgtgatttttttttaaggacccaaattttaagtggcaaaagcaaacttttctaaggatttagtaaaacaaactaaaataaaatccttcctgggtaaatacctagagtgcagtgcaagttcatgtctatctccagcaccttgttcagtgttgtcatgagagcattggtttataaaatggtaactgtgaaataccaaaggaaaattaagtcatcttcctatgttgtatttcccaaggtaggaaagtatgcaattatattttaaagatgcttagataaagcatctttatcatttcaaaagaatttctgaataatttattctttggtaaccaaaaactataaacgatcccttttctgtgtaaaatgtcagtacttcattctgtatgtatgkattcatctgtcaaacattaaatgaacacctgttatgagccacattgtgctaggtatatatgacatttagaatcggggtatatgaaataacaatttggcacaaataattgtctagttaataaaacttgttttctggtctttcttagactgatatgaaaaccaaaggaagtttgctgtgggttttagaccacactaaaacttcatttgggagacggaagttaaagaagtgggtgacccagccactccttaaattaaggtaaaaggaattctttttggggtgtttaatctgaaattataaaattttgaaattaaaggcattttaaaaccaaggttaccattgtttttaagaacacrgttttaaattggagaacattttattttagaactgagcaatagactggctctctagtattacaaggatttttttcctcattctcgtgaatgagcctgcctgcagattggcagacatagggcgttgtcccaggaaagtgaggakagatgccttttgtggagggytttgaaggctagactgaggagttgatagccagagggagttcattcagtgattctgagcatggggctgatatcatcagagctgggcttgtgtgtaggaggggactaagtggtagtagtggtgggatcaagttagcaagttcatggagaggtgcccaggacctgagctacagcagtaatagcaaggagtccaaaagaggggttaggtgtgaaatgcttagaagagtagagtgagtaaagttggagctccctaagggaagatacttgaatccagtgcctaacatacagtgatttccaaggttgtctgcacatcggaatcacctgggatgcttcacaaaatactcatgcctgtgtccagcccccatagattgtgatttaattggtctccagcatgaccagggagttgagatttaaattttacccagatgattctgatatgcagataaatttggagattctgacctagaacagtgcctggcacttagtagaagcccagttaatgtttattgaatgaaaattgttatttattgcacactttctatttactggtgtttaatactcaaaatcaccttctgagataggttcttgaaatgaggaaacagattcagagagcttcactaacttgcttagtgtttcatagctggtagagataaatataagatttaaaaccagcattgactccagagaccttagcaggaacaagccattatcctgaatagttatacctctggctagaccagagtgaatatggtgtgatggtgaagagaaccgctatgtgttggctctgtcagctgagtgagtcactcccactaatcctcagtgttctcacctttgacatggtggaacacctcatcacagcattgctgtaaggaataaaattttgagctctttatctcacaccacacagtatgctaggagctttatgagcattgtctcttttaaactgcacagcagcctcactaagcagatgctgttattagccctgtgttactctgtgattaataaatagtcactattttcaataatggattgcagatgttaatgttggtcataggcttgaagacactgttatgggttttgctgttgttttcttctttttcttttgcaagtttttttttttacaatgccaactttaaaaggtcactaaagttaactggacaataatctaggcagacatcactttacaaaaaagagggaaagcccaaaatgccaccttctatagaaaaygcacagtacagttttattcagagcaaagaaaaaagaaacttgatcatactatgagaaactcagccataggtttggaatccgtattcacaccacacattcactgaggacaatattctgctcatacgattgatttgctrctgcatttcactgctgtttgtctgatattaacaattttaaacagagcagggcagctagtatttggaacaatccttacagtgtgacggcgtcaaggacgtttcacttctgttcacaccgctggttcgcttggcatacctgggtttcctcttcttcagtaaagtcatttttgatattggaagtcttgcgaatcttctcaggacttttctccttgattgtatkggcaacagtcttgtgtgtaacatcaagcaaacctttgatgtctaagtagtttgcaggcagaagtagtacaaaaagtattccttgatcgactttcaggaattgttggtcctaaggagggatctcctctgttcgttttctttgttcgcatcatcctcgggaggaggacggccatttttgtggtgggtacaccaccaaatgaccttttaaaaatattgctgcattaactttggtagaggagctgggtcgttatctccatcrtccattctcatatcttccaacatggtcttgatagtcacagattgtttggcaatttccacatcaaatatctccgcatcaaaactcagcatcttaattgacggcatggtgtttgagcttaaggagaccactggccagaggctcatgagagyagggcgacatcagcaaagaagaggaaggcagaggacaaggacactcaagacatggtttggatgatgataattaccaaatcttttcagatttagtgggtcactccgatttcttttcttagccataaagaccttaagacatgggaaactgatgaggtaaagaagaaatcctgaaaatggaaatatcttctttagttcagcattctaatgaaataagcagaccttgtagagcagacgcagacaagatggctttctgtggacaacagtgtaagggatgcagcattgtggctgctggaaaggctgcctaaacatctactacaattcttactgtgtttttgcttacatgttacagcagaaacagactcactagcagacttttccatgtaaattaaaattyttcatttccaatgttaaatttcctttttttttgtgtacccaggattaatttgagataaatctagtagaccatgttgtctgttgttaggcgccgaatcatgtatctctggggatcctaccttcccagaaaggcagagagaaaatatgccaggcattcaacactgatgttttcaagtatgaacttttcactgacctaacactgatgttagccaaaaacaaacacacgaaccttttctttgcccttttattttaggtcatggtttttaaacttttatactcctaatctattaaaatctatttcaaaagaattccagtttaattttaatggcacttgcaacgtattccaaacaaatacctggagagaatctgctgattagtcagtggctcagctatataattagtcatgtaccacatgacaacattttggtccttggggattgcatatacagaggtgttttctatgtttagaaatgtttagacacacaaatacttaccattgtgttacagtagcctacagtatttagtagagtaacatgctgtctgggttttagcgtaggagcagtatactgtaccatatagcctaggtgtgcagtgggctgtactatctaattttatgtaactatatgctctgtaatgtccacagaatgacaaaattgtctaacgatgcattttccagaatgtatccccatcattaagtgaggcatgatggtgttgttgtttatactgacataagtgccttactgatcacatcagtggctcatccagacaaatattctgtctctgacattgactgccaaaggttagtttagggtctggttttcttctacagtgagatcgtagaacaaataatggatgacgaggggatttagcaaaataatgcagatctccccaggttctgcaagatcccattgtttgtcagtcatccatgaattctcctaaatcccttaagctcctctttgtatttttatcttgttctagctcttaagggcaaacacacagttcataagtctaggaccaggcattcaagtttcagaagactttccactcccgtcaccttttattctataaaatggtctctttggtgcaaaattttaatagtgacttttagaaagtaaaaatgatttttactttacttattgactgattcaaagagttcacttagattattgaggctggattttactgtactgatatcacattagcttttataaatagattattttttcttatgtgttctcacctgtagtttttatcagttctgctaattttaggcaagaagattcttcagtgtagttgttttttaaataaatgcatgtcacattggcatgccattattcttaaggccttttaaaattagattatatcgaattaattttttttgaggttctgtctttggacttctttcagttgatatagtcttgtcaattttttatttacacacacacacacacacacacacacacacacccatatgtatgtcattggttttgtcaaaaagcctgaaaatgcaaattctgcttgtaaatattggtagaggagaaaaaaagaaaaccgtgagatgagtctgtgttccagactcattggtgggttatgtgggatgagtctctaaaatggtgagttaagcaaaataattaatttccaaggcagatttgtttatcttagaggtattccactttcagtagcatactatatactttaaaaattaaaagaaatttagtttctttcatgagtacctctttcttctacctgtactttacattttttaattaaaaaaatttgtaaagttttatctttaattgacaaataattgtatatatttgtattagggttctgtagagggagagaactaataggatagatgtatataagragtattgacttacatgatcacaaggtgaagtcccactgtaggctgtctgcacgctgaggggcaaggaagccagtctgaatcccaaaacctcaaaagtagggaagccaacagtgcagccttcagtttgtcgccaaagggcagagagtccctggcaaaccactggtgaaggtccaagagtccaaaagttgaagaactgagagtctgatgttcaagggcaggaagcatccagcacaggagaaagatggaggcctcaagactcagccagtctagtccttccatgtttctctgcctgcttttatcatagccacactggcagctgattagatggtgcccaccagattgagtgtgagtctgcctctcctagcccactgactaaatgttaatctcctttggcaataccctcacagatacacccaggaacaatactttgcatccttccacccaatcaagttgacattcagtattaaccatcacaatattcatggggtacaatgtgatatttcattacatatatacattatagaatgatcaaatcaagctaattaatatatctatcacctcaaacatttatcatttttttttgttgagaacatttaaaaccctcttttagctattttgacacacatacaatgcattaactatagtcaccgtactatgcaatagatcaccagaacttgttcttgtctaaccaaaactttgcaccagttgaccagcatctctcttttccccatctaccctctcccctagcctctgatgaccaccaatctgatctctacttctatgagtttgactttatttgattttacatataagtgagatgatgtggtatttctctgtctgtgcctggcttatttcactttgcattatgtcctctaggttcatccatattgtcaaatgatagaatttactgcttttttttttaaggctgaatagtattccagagtgtgtgtgtgtgtgtgtgtgtgtgtgtgtgtgtcacatttaaaaaatctattcatctattggtggacactttggttgtttccatatcttgataattgtgaataatgtggcagtgaacatagggagtacagatatttcttcaacatactgatttcaattcctttggatatatacccagaaatggaattgctggatcatatggtaattctatttttagttttttgaggaactagcatactgttttacaaagtgactgtactgatttataataccaccaacagtggacaagggttcccttttctccacatctttacttgttatctttcatcttttttaataaaaactaatctgaaaggagtgaggtgacctattgtggttttaatttgcgtttctctgattagagatgttgagcattgtttcatttatctattggccatttgtatatcttttgggaatcgtctattcagaccttttgcmcatttttaaatagggttatttgttttcttgttattgagtagtttgagttccctgtatatttggtatattagccccttatccagtgtttgatttgcagatattttctcctagtccctgggttgtctgtttactctgttcattgtttcctttgctgtgcagatttttagtttgatgcaatcccattcgtctgttcttgcttttgttgtctatagtttggttcctgagcatcccaaggctttttctcaagtctttgcacttgttagtctttgtacttcgtggtctctctacgtagaatattcttctgtttctctttaatctttacagggttaactgcttgtacttgaggtctcaacttaaaacgttgtgttaatatcttcggagaggttttatttgacctcctaatctaaattatgttccttgtatcactcattgatagcatatagggtttaatcatgattgttacctatgtttatttaatatgcatggggctcttacattatctgtacaaggggtcttcagaaagttcatgkaaaatgcatattatgaaaaaactttgcatagatttcaaaaaattttggcaccaaaataaactcatactaacttgttagagcatgtctcaataggatgtagtttgaggcattaacagggataagatatcagtttgaaaagagcttctatcagaacaacatgaattctgctaamaattaaagcgagaacaaacaccatatttatggtgaagcttgggtggaagagtggtgacatcattaatgctttatgaaaagtttcatgagacctcggaataaacaccacacatctacaactatctgattttcgacaaacccgatacaaacaagcaatggggaaaggattctctatgtgataaattttgctgggaaaactagctagctggagactaaaagtccaagatcaaggaatccttctgaggcctatcagggagaatctgttctggtcctctctcctacctgctggtggtgtgctggcaccctttggcgttccttggcttgtagatgtagctccttgatctctgccttcatggttacatggtatgcttgctgtatgtatgtcccttcacacagtgttttttaataaggacatggtcatattggattaggggtctacccttactgcagaatgacctcatcttaataattccatctacaataaccttatttccaaataagataacattttgaggtagagggataaggacttcagcatatctttttaggggtacacaattcaacccaaaacaaataggcccattatttccagattttcttccttttggcacacatagactgattatacccatctctttactagaaacaagtgttttgattattatttaaatgttttgctcatytattcaacgtctgatgtgaggttgtaaataaccattgaattttgtaaaattgccaatcttgtgcaattttgtgtttgtagtacagttctctgaaaagttattctcttatctttgacaaatatcctggacagtatctgtccaggtgaaggtatgtatgcaaagtgttacattaattttagagatgaaaaagaaacatttatatatatatttaaaaataaaggaaaatgcctaggaagaaagaagcagaggtctgaatctgagattcgaagaaagaaaagtagccaaggtggaatgggagaagagctgaggtctaagaggtaaggtgtgttactctgggaacatgtctttgtataggacaagcagaggacttaaagctctgagggatcaagggagtagaaagaaaatgtcagtctagtgaactaatctctaactgtgctttattttttatctgtrtttttttcagctatctttagagatagttattctgttttagagataagaataactaagtctcagtttttccaaggtcatccagccaagcacataggggaccttttgaaagcatagttttggagttaatgatacttcagcttgagttctgattcccttttgtcactttggagaagttatgaatttgtatatacctcagtttcttcacctgtaaaatgggaattaactacctacctcattgtggtgttgtgaggaccaaatgagacagtatatgtaaaaggattagtgtggttcctcatagcaattttttggtcaagaaggtagccatggtctttagaataccaaaaaattggaagcagtgtaattattagtagggaaagggaaaataaattgtctggttatatattggaatattatacagcagttaaaatgaatgacttaagtctatgtgtatcaacatggataaatctcagaaaagcaatgttataaaagaacacataaatgatatcactaatttaaattttgtcacacacaatatcctgtttaggggttcaaacagaagtggtgttttcttgtcacataggcagtcaagacaataataacttctgggaaatgagaaaagggttagagatacaggtaggctggtgttttacatgtatttgcaatatttaatttttaaaaaattatacagaaaatacacacacatgaattttttataatgtrctgctatttgaccttcactaccatcayaatcaggtgaaaatgagacccatgcacatctgtctagaaagcccatgttgaacttgagagcatctgttttccagcacatcttgcattagaaagacagaagacagccatcagatgaccaaggcttccagggatggcagggggaaggctgggtgcttgcactgtcagtttctaggatctgcccaggtcatttcttttcctgaatctggtacttgcctgtgttttcttttgcctgtagctaccgtcaggaatgtagggagactttaggaggattactggtgagtaggtagagtcttttatgggggcctactctcaaaataatataaccatgaacaattgaggaatgtttttttgtggtcccttttatttatgctctaaacttgactagttctgggaattgaggaatctcaacctcacgttctgattgactaagtaaatgctaatgtgttcgttaacacaaaaggcaatgcattggttagggaagctagctgttaacacaaagaccccaaaaagtctaatggctctaatgttgtgaaagttaatttcttctttttttttctttgcrtaaacaatccatggcctttccacattggggggtggggtgagactctcatcacataggcagttaggaaccccagaggctcttcagttttaaacgtgtagcttccaaygtcatcttgagaactgatattcagcagtggaaggagaaagaacagggaggatatacatttatggcttttatgtgaggcaggccttgcattggcacatacccttctgcctaaatctgattataagcagaatgcattccgatggtcacagcttactgcgggggctagcaaatgtctgcttgtttttcaaggaataggaagaaatgtttagtgaatacctagcagtctgttgccagagatggtttttgttgtttcaattccattgtacrttcttcttagcatttaaaaaattatttgaacttttgaacaggcaatatcttcacatactttaaaagtttgaaaatctgaaaagttacacagtaaaatgtttgcttatcattcctgccccacatctactcagatcccactaggtaatcatggttattactttatcatgtatacttccagaaaccttttgtttaaaaaagcaaatatgaattwtatatatatatatatgaaatctcttcctcccttattacatagatggagccataatatacccagtactttgtacttggctgttttcccttagtagtataagatagttattttaaattttgtattattcagtctcagtgacaaggtggcgttcccagcgtcagggaatttctaatctaatctggtcaaggtataatctactagtaaggaggaagagatacaagtagtggaagcttttgtactaaaatcaaatacttacctgttactcactctataactcaataccacatttagagcaaatgagtaatacctttataagtcaaattagatttttagaaaactgctttaggaaattaggcatgctaagataattcttggcatttaaatcacataattaagggaatagaaaatggtttgtgttaggaaatagatctttgactacatttttgcatgactttctgatgtactaagtacattttagtggtcaatgttctctacattaaatggcttttgttttggtaaacccatatgtttggagtattaatggttgtatttctaatttgttaccctggcccaaatgatgaagtaatagaatgttgcatatttccttccacttaacatttaatttgtgttaatgaaaccaaatgtcacttttaactctggaacttctaaaatgaactacaccgggaagccctctgtattctttgtggtttcccatgttccatgagccagcaaccgggtgttcacttgcagtgactctggtttactcagcccctggggatgcattactgctcggaaatgggaagggagagtagcaggtggtgcgtaattgagagctgtgtttgattgggactgacctggtgcccctttcctctgccggkttgaatgagagtttaaaggaggaactgctgctgctaagaacaaaatgaacccgagtgcctcttactgtttgtcccgactgtcagtkcatagggattaactaacatccaggaacttttagctggcctctgctttgttcttcaacattcggaccttcagtgagctctagacctgcacaaacgacctgcagcaaatggcagctttcatttgggctgaggaagaggaatattggagagaatgaggagaaggaaataaatatctttcctttttggcccttcctgctttatctttctccatctttatgcctttattaatgaggattttccaaatatcggtcttcaaaaatgccataagaagacttcattttctgtggttttaatgtcataaaatatctccttatgtgaaataactagatatgctggatcaagcataacaaacatccctttaggacattgctgaatctgtatttaaaacataagggaaraactgagggaacagatggaaaaaggaactggaaatggaagtgaattgactgctgcagctgccctctgggctcctgcagatcttggtaatcaaaaggattggggttcaactgccttgtgggagacaggagacagggtcttgggtccatttaagttagagataccatagtaacgtgagacactcaaaggactgtggtctcagtagagaggtgacaaatacgtcttgacctgttcttgcctgaggaaaacgtttctaagaattcttaaccacaggccctccctcatagattttcagtttcaatttatactctgtgtggtctggcaatttccaagctgtgaaacttatttaaaacagtctgatggtactcacataaatcaccaagttaaaaaaatacaaaatagaataaaaaatatgagcatggaaaataaatactatcaaaagggctcagattgatttaaaaaggaaacacagacaattctttaagactgaatggactaaagaactcattcatgtaaccaaaaaccatttctgccacaaaaactattgaaattaaaaaaagaatgacttaaataagaatggatcttatactccaaaaagaaagaaagaaaagaaaacaacaacaacaaagcaggatatgggttaaacaagaatagaggaaataactgaaatgcaagataatacctgaagaaattacctagaatgcagcacagggtggcaatgtcaggccttcagtgtttcttctctggatttttgaaacagctttctaactggtattcctgacactgytcttatgtgcatccagactattagccttggatcccagctcctgtgatcacattttcaaaccttcaccctccattttccactaatcttttatagacaatagctaatcttttactcaatagctacccccaggaaatcctccctgatcctaaaactgcatttgttcgttaggtrctcctggcctgtgttcccattgtacctagatcataacccagttataatyttattacattgttatcattaatgctttttaaaaagttttactattcatcactagagtgtaaattgtttgtagactagcaaagctctgttaacaattatagccctaatgtctaccactttgtacaattagtactttgtaagcactcagtaattgttcattgaatgtaagaatgaatggtgtatgtgaaaggtgaagctatataggtctaatgatgcttagatcctaggaaagggcctatggttcatgtttctgacaggagattatttaggtagttcatttagccatttcacatgaccartgtgttaatgtctgaatttaatctactcgttctgtgytgtcttaaaagtcaaacttttcagtaaaacgaaaccaaacaaaaaatacacccctagcagtttgtatttcagctccccacccccaccagacaactttttttaaacattttatgttggtaggtacatagtaggtctatatattaagggtatatgagatatttgttgcaggcatacaatgtataataatcatatcagggtaaatggggtatccatcaccccaagcatttatcatttctttgtgttacagatattcccattatactcttctagttatttttaaatgtacaataaattgttggctgtagtcaccctgttgcactctcaaatactagatcttattcaatatatctaactatacaaaattatcttaagtttgaattatagaggcattttcacagtagcaaccagtaggtactgactccatcactgacaatagctataggtcacactcygtgtttctgagtgacagccacacatggtagatactcatgtcaccacctagtttatcttcaaatgtgaaggactccagtgacactcacatttagtcctttcatctttggtagtaaagatgaatctttgtcatccccaggacctcttctttttgtttgtttggtatatggaatgaaatgactcaggtgccttctttcagttaatttaagttgtatagtaagatcaaccgtagaatactatcagtcatcttggaataatatctttatcatcatccaattgatgatgcttcttccagttttgtttcctgttgctatcactccatctgtcattaattgcactaagataataattctctattgtgtggcctgacatactgttttattacaattatttggaaggtcttgttactactgcacattaaaaaacaattctaaggtatgtgaattgtttaatatttaaaaatgtagtcattcttgcttatttccattctgatcttcgtacaggagttgaagatggaattatacctaaccgcagtgatgagaaatttgtggtgaacagtgtcacataccctttcactctctccctgcccatttagacctccataattattaatagttacattgtgctttctcaatgcaacctactgtccagtctcagcacagcgagtacttcagatcattactacttgtcaggtttagcactcaagatcccaggactagcttttcttgtataattcccacttgttgttcactttgcacaaaatacctgtttacatatctatgccctaaggtttgtccatacatagttatttctgagctcatattttggatgctatttatccctcttccatgctgttctttgtagtgtctactacacaaaatttgtaacgatgtggtaacagtaaacatttatgagtggttgtcatgatgtagcaggtactgtgttaagtacctgacatttattatttcattgaattcttgtactaacaccaagagttagggctcattgctcttctcattttataggtggagaaactaggacaaggctaaataattggtaaatggcagagcctgggtttgaatcaaggccacctgacttctgagcccaagttggtaacctctgaggtagtccttaaagaaggttgggttaaaaccaaactgattgatagtgaacatactgcttttgcctgtgttggcactagactaaaataaaaaccttttcctttatgttttcccagattccaaaccaacttggcctaacctttcaagtctctaagaaatttatagttttatatctattaaaaaaatcttctggtagacttcataaatatgacttagatttttattaaacttttttgctcgtatctttctgtatctcagaaaacctttaatttttgagacagtagctatttgtgtaggctgtcttatatgttcacagatggcattattttatcagtcctcaaaccatctgtagcatcaacttagtctattccaattggtgtcatctttcatttatgcaggagtgagttattaaagtaaaactttatatttgtataacattttgggtaaatgttagagtaaaacattggtttattttatcacaacaatcctttgcaaagaaaatttattttttccagctcatcttgatttactttatatgtagtcttcagaatgaaattgaatcgaataactgtttattgagcacaaattgttatcctgaaatgtagggataagaaatgacccctgtgttcactgaatttatagtcttgtaggaaagacagtgaagtagtaaattcccattgaagaagaaatacaattatgattaccattatgagaagggaaaagacggtagtatgggaaatgatagtaaagggattaagtctggtctrgtgaatctagaaaggcctttcagaggaagagagggtaggagttcgccagacgaagtgtagctgatgggtggtagggaagaggaaaataaccttctaggcaaagtaagcagcaaatgagaaagcctccatgtcagagagcttggagtaactaagtcattgaaagatatgcagtctgactggaacttagagtaggaggaagagagtgacacatgatctcaggggagacccaagagctaaacaggcatcagttgttttttaggacaattaaagattctggatttgaacctaagattaatagcaagtcacagatgagtttaaagcagaggtgtgacatgaacagatttgggctttaggaaaaccactcaggctgcagtgtggagaaygagttggaaaaaggaatggaagtggggaggaaagttaggaggctgtttcaatataatttggacttagactatagtagtggctgtagaggtggagagtggtggatggattacagagtccaccctgctgagaatggaagagccagcccgtgtgtgtacaaagctctgtcttgctctcctgcatcgtactaacaaatggtccttctgcatgcaagagtatgagccagagaaaaatggaacaaaaatgaggcctgaagttagtatagaagctctgtattatgaaaaggcatgatctcacaggtagttaaggataataaagacaaaagcactcactaaatcgaaagtcctcagtctgattgtaatctagccaggatcctgatctaagatttgcttttcatatcagtgtgtatgatgtcaacagaattttgagagacaccaagtttattcagtggctgatgcctcctttcccccaaaacatcagttcattctttcatccacttgtttatttattcattcattcatttacaaacactttaaatccttactgaggacttactactcaccagacatgtttacttatcttagtttttaatactacagatggtcattatacctagtgtgggcctttgatgtttataggtacttcatggaccacatctcattgatgatacatttagtccatcagatttccgttttaagttgagtcatcacttaaggtgtagccgttggtaaaatcccgcagcactgatctcctatgtatctgaatgtcatatcctctgcactttctattgctactccccaatctttggtcagggtcaatatgtttaatttaattcattcaaacagttggtcagttcagccatcaccaccaccactaggtcgtcttgttggtcattgtttaactattatattagccaaggtaatgcaagctatcagcaaacaaattctccgtctaagtggcttaaatacattagaagtttatttcttgctaatataagttcaattggtaacagatccgggaatggtggattttctgctccactgtgggctcaggctgatggagttaccatgaggctcacaagcttgcctagctggcaaaggggattaggagaatgtgaaagcttattcaggaagtttttatgggccagggctagaggtggcttacatcattcccacccatgcttcagaactgaggtacatggccatacctaactacaggggagactgggaaatgtagtctttgtgtttgcttggtgagcctgtctttgtcaaacccagctagtgaatttccttgtatgatacctgctctttgattcagataataataagaggcatggaaggaccagatatattgttgtaggactttttccttagttcagttaaagacagcgaggttgggggagggtggtcctcatcacacagccatgtaaaattaggcccgcagacaattcgaaggaggagaaaaatggaatttattgggcaaagagcaataaaaagggaaacaaagactctccaacaagacagaacgagaatcttgctagtatgcttcccgcctcacagactgtaatcccaggttccacccaggaggaggaggggccaggctcctccctgctgccaaaggcgtgaacttctgtgtctccaccccagtgcaccctcctctcaatgcatacgcccattggagttttgtcagggagtccttcccacatgactatctcagtatgaaggaggagtttcctttgtgcctaataagtggctgtgtcacattcctgggcattagagtgggaaatgtctatattctgaattcctaacatatctgattattgctattactcttttctcacagggaaataaatgcccggcttgatgctgtatcggaagttctccattcagaatctagtgtgtttggtcagatagaaaatcatctacgtaaattgcccgacatagagaggggactctgtagcatttatcacaaaaaagtaagtgtgatagaaatctattaaagctgacagtgttcttcagcttgaggacactatatattaaaagaaaacttttgagagctctattattattttattttgtaaaatcttacaaatagcatgcgagagtagctgaatcctcagaaattttaatagtacaaattagagttattccaatttttccattgtagaaaataaagttttctcatgtgccttaactacagcaacatagaggcccttctgttataatatagggtattctcctgtttcatcctgaaagtacagactattatcaaaataggaaatttatgtagacttgttattttagaaaaaaaaaaccttatttcttttgatcttagaacaacttattgtttcttaaactatggaaaaatctgctagtataacatctgtggtggtagttagtatgcaaacaagcttggatattgaaggtgagtaaaggattattttgatttttatcacttaagctttacagtttgagtcatagcaaaaatgagtcattttccacggttagggaaataatttaggttatcttcaaaatatgcctaaaattaaaaaaattattaatatttttaaatgataaaacactataaactatggtgttttactttttgcagaagtcattcacataccttatactctttgttccttatcaaaactttatgacattgagaagttactatttttattaccttcttactaataagaaattatatctaatgctatatatgtgtgtgtatatatatatgtatatatataaaatgctgcaaccacttgaattaccttggctaatatgatgatgctcagaggtttagtaacttgctagtaacagaatctgtatttagacccaggattcttgactgtgttttcattggctgtgtcttttggatgctatcatgtttgatgtagttatcttgactgccattttttttttctggttgccacttttcataagcaaattttatttttcctccaaatgtaactccttgccaatttaataattttactgtgtaaccatttttatgtgcctaaatttttattttattttgttttattttgttttattttattttattttaattttttattttattttattttatgttatgttatgttatgttatgttatgttatgttatgttatgttattttatgttattttatgttattttattttattttatttttgagacagacttttactctcgtcacccaggctggagtgcaatggcgtgatctcggctcactgcaacctctacctcccaggtttaatcgattcttctgtctcagcctcctgagtagctggggttacaggcacccgccactatgcctggctaatttttgtatttttagcagagatggggtttcaccacattggccaggctggtatcgaactcctgacctcaggtgatccacccgcctcggcctcccaaagtgctgggattacaggcatgagccactgcgcccagccaatatgcctaaattttagttgtgaccaatttttcattagtgtttctatatttttcatccccttttacccccacagagttttactagaatgataagtactgcttctaagaatacttgaggtgcccaagaggacttacgtaactgttttacatgcctcagctaaatttgaaaacaatgcacaagccagaactggaaatactgatcctggggagaaagatatatgagttggttatggggcyggggagcctattgcatcattattgggtacaccatgttattgttttgctggcaatagcagaagctgtgctgatagtcgcaagtttyatggtagacctttttgaagttgcaatgtgggtgccaaaccatttgttgtttttatccttggctcagagcctgaaaattgatgcatattaaccttctttaaacaacagatctccaggcaccttgccttaactacttcaaaggattcactgacagatgtcagagatttgaaaacagaagcaaagctgaaaatctttcagtggctactcaaatgcacaaagtcaaagtgtccatggcatcaagatggcagcatcagttcatggggctgtgatttctattccaccttcctgcctttttgtaaactttactttgatgtttgtattgcacagggtttgtgtatttataaaagtttcaaaactctagtaaagtcagaatctaattcatttaaaaagtggccggtatgcagtgcaagaatgacttattttggaatttcaaaatatagtttactaacggaacttataactcacttggaagccattccttgttgctgttttagtgtttgtttacacaagaatgtacctaaagattagtttgaagggtgaagagtagaaatgatctggtaacaaaccaacttcaggaaagctgaatgctttaaaccaatgttttatagattagttggctggctctgtgtacacaccatcaaacatatgtctgttctttattattagattactctaaataagcttctactgtgtacaccacatagtgggtgatgtcctgggtacagattrtgccaattatgtgaaattcataaaatgagaaggaacactggatgttgtgggaagtggttagcataggctgtatggttttgtggaacgtgccctggaatatgtaccaataggtgtttttatggtgataatgatagaggatctcaagtgagctgattctggtataaaatagacatttcttcttcttctttttttttttgaaacaagatctcactgtgtcacccatgctggaatgcagtggtgcgaccacagctcactacagcttcagcctccagccttctgagtagttgggacaacaggcacgtgccaccatgcccagctatttttttttttttttttgcatttttttgtagagacaaggtgttgccatgttgcccaggctggtctccagctcctgggttcaagagatcctcccaccttggactcccagtgtgttgggattacgggtgtgagccactgtgcttagcctaaaataaacatttcttttgatggcaaaatgttaaattcaaatcctgtaaatagtgctagtcacaggaacccataataactttgctcaagaactgttttgtaagaaattcttaagtaactgccgaggttggtgaatacatttaaaggataatcgcacttagcaaatgttgaggagagtgttttcagaatttcctaggtgaaaatctttttttagctaagcaggaataagcccacagctgcatgttcagtgtggcacttaagctggggtccttcccatcctgtgtccagtgaggccctgccaccatacttgtgggtctgtgctcaagctctcccagtgagacagctgctgccagaagtagggctgaactcctggagagtgacttcaggagcagccacttacccatcctcagctttcttgtagcttcttttgagttcttttgcttaagaaacttgagaacaacctgctgcctctggctttcaacatgattgtaaagcactactggttttcaccttgcttctgttgctgacttaactttacattgtgtctcagcttggaaaattaatcattttcttgggattacaataatcataagaggttaatattcaaaattatattgaaaatgtttgtgtttgtttctttacttttgttaaaaggtatcattaattgactagtggccaaaaagcttccaggtttcacatttatttaaacagtccagcttcctgtatagggtggggagggggtctttctggagaaaagttgcctcatgatacacttagaattcaacatttgctcagttggacctaacttcttattttttttgcataattcaccctttgtggttagtaattacctttttgaatacgttcttagccttaatctatttcatatatactatctattatgtgccttattactttacccctaaattgttttctcatctcaagacagttcttttcagccaacattttgtcagttttattttcctgagctgtcttctagagccttctaacttgatccagtctggactggttgtccccatatctgttgtatagtactatcttagattccctttacttcccttgagttgaatcttttattttctatattccatgtcttcctcttcgtttatttcttcattttggtggagtatatatcctctagaaccttcctgagaaagcacgttggaagtaaatcttttgaaacattsatgtctgaaagtggtttttttgttgttgttattattgttactaccttcacatttgattggtagtttggattggtataaaattctaggttttagatgacttcattatctttacttcctcttctgttgaatttttcatttctactattatgctttaatttccaagaatttttgttttcttgtcctccaaatgttttttctttttaaaagtagcatcttgtttcatggttgtagtatcttctgtttcatggaagatattattaatatttttagaagttccctaacagggcagaatccatattggtacacaagtctttttggattcttgatgtaaattgtgtctccgttttccttaaggacagtttaaaattcagataccttgagtcttttaagtcaattactgtttatttgtttactttatagcttctaacatattattgctgttgtcttcttttctagtgtgtttttttccttttttttttttttttttttttttgagacggaatcttgctctgttgcccaggcaggagtgcagtggcacgatctcggctcactgcagtctccgccttccaggctcaagcgattctcctgcctcgccacctgagtcactgggatcacaggcgagcgccaccacacccagctaatttttgtatttttagtagagatggggtttcaccatgttggtagggctggtctcgaactcctgaccttgtgatctgcccgcctcagcctcccaaagtgctgggattacaggcgtgagtcactgcgtctggctggttttatgccgttttaaacaatctcttaactgtcgtttcaagatggagagaaattagatgcatgtgtttaactcactgtttaccagaagctatgatataaaaattattcatgttcatgttaaaaaaaaaactacagtagtatgcaggggtatgcagtaaagggtaaaaagtctccctctgccacccttccatacctactacccagaggtaaccagagtaagtcacatgtgttacctcctaaaatttttattgatatttagattttttatttatatagaataatgtatatcatttaaagaatacaaagaaagtgttaccatgtaaatacataaaaatatatacatatatggtatatgatataaacatactgtatatattcaatgtatgttgaaattatggagttctatactgatgcaaacagatcttaattttcttttagctgtttcgtagtactacactgcatgagtttttcccaataagatcccaattgatggacatttatttcttattcatctttttaaattataagcagcgctactatgaatattcagacacacatatttttcactatttgttagtctatttttagataaattatttaaagtggtgcttattcaaagggttatgtgcacttttttattacgaagacatgccaagttgtttttcaaaaaggttagtcctctgctaagagtatataaaagtgtcttttttttcttttacatcctgttacatggttattgtgaagcttttaaatctttggcgttccgataagtgaaaaatgctatcctatatttctaatttgcttgtctttaattatatatgaagataatcgtatacatacttgctgttctctttctatgagctgcatattcagtttgtttagccattgttctttggattattcatctttttcttgtcaatttgtaagagcctattatgtttgggagaattttgccttgtgtctgttatgccttacagatattatccttcacattttttaacttgtttaacctatttttgctatatggtttatgttattttaaaaatgaaaaaatactaaacaagtattggctttgttttccttgsctaaaattatttcctttatacctttaaaatattacatagtatttaacctcatttagaaaatatcagtgatattttatttcaactaactagttaatagaaaatttaaactttcctcaattctgattctaacttttaaaagtcactaattaaacttcattttcatgtatcttatgctatttcataaaaaatatttctrttttcagtgttctacccaagagttcttcttgattgtcaaaactttatatcacctaaagtcagaatttcaagcaataatacctgctgttaattcccacattcagtcagacttgctcyggaccgttattttagaaattcctgaactcctcagtccagtggagcattacttaaagatactcaatgaacaagctgccaagtaagtaccagaccctgaattcttccttttcaccagtcagtataattcagtgcatttgccatttatttgtggattcttaatctttactagaataataatagaagttgcatgagtacatatataattagaaatgtgattggaccctaaaagtgttacattacagctggaatacttgctacctaaaatttaggcagtttaccatctaggacagatatagtactcccccacatatcagatgatggaaaggtaaaacacaggcaaagccaagcattagtagtttattaaccccaaaatgagtgtcagatatcttgtactcatttcctatatttccagagatgtctttatatttagaatctgtaaaagcaaagttatcctttaaaaggtagttataacatattgcacaaaacattctatgtaaatgaaataggatttgacatttacgtttgtctttgttttctgcataggcaaacaacaaataatttatctcttggttttaccatgggaatcatgaagttaaaaagcagaaatgattttagggtaattttgaccatcctcagagaagttaaaaaacaaatccataagtgcttagtgacaattggaaccacatttttctgacttccagtgctttcctcttttatcacactatgaaaaataagcgataactgctgtaattaataaacttcgaatatgtatttgcatgttttgattttttagagttggggataaaactgaattatttaaagacctttctgacytccctttaataaaaaagaggaaggatgaaattcaaggtgttattgacgagatccgaatgcatttgcaagaaatacgaaaaatactaaaaaatccttctgcacaatatgtgacagtatcaggacaggaggtaatgtcaagcttacttttattttctattagttttactctagtagaaaagctattttaaaatgtaaatagaaatctgaggataggatatgtattatcttttcaaattttctgttttattccttggaaatatgttgtaataacttgttttgataagagttattttaatgatagtgttttattagtctcttgttaaagtaatgcaacttaatgttatatgtatattagcgttatctgttgaaattatattatagaaaatctcaattactatgaataacaacttatagaattcatttgttctaaatccaggaaagagaagttagtctttgatccctaccttgcagatgatgaaatgatacaaagcctgtgttgattggctcatacagtgattaaacggtggggcttcctcctaaagttaagagtatagctgctaaaaaaaacaagtctagagtgaaaaactacagttagtgagtcttccataaaattatggtactgtttagaatatgtttcttgggggtgtgtacttctgtttaaagtttgatagtaatgtctgaatgagaaccagaaaaggaagaagtatgccttttaaatatggttgtgcttttcwgtcctattctgggtcttgaggcatgctactcctatatcttatgtttaataaaatatgaagattcaaactgagggagtttgagaaattctgttttattaaaataccaaattaggaaacttatggttaacttctatagaatgagcattttattcaggattttcaaaaaatagatatttttccggtggggaagaacttaatttcaaatcaaatttttaaacatttacattgttttgtgtgttttgccaaaagattgttgaatgtatagttatttgaaataagaagctctacattaattgagaatgttcattaaagtgtttattagtcttgtgttatttcatagatttacccattaagtcaacctgtcttctgaactaaaattattaagatattatactcagcagacattcacaatgccacatagagctctatataacagaaaaatgatttgacaatatttatacttatgtttattgtctgaacagacaaataccaaatatttaattgtaactcttgtttttgctatgcagtcatgaccttgcaaagtgaaaactggcctaaaggccactattctggctattggtttaaaatcagatgatcaacactgctttagttactttaataaaagatatgtagtagaaaagtggctgccttttctactacatttttttttttttttttacagtggagaaagtaagtgtaagtgccarttctaccatttacatgctatacgaccatggaagagttacctctgttgtaagactattatggagaccaattaagttaaaatacatgaaagtgctttttaatcataaagtgctatgcttatactactcatataataacaataatagtaatacagttaccatttatcaagtacttgttaaagtctagaatggtggtaggtgcctacatatattatttaattcttataacaatgcccaaaagggtcattccagtttgttggaaagaaaaccaaggtttggagtagttagataagttacccaaggtccgaagcacaaatccagcccacttctgccagactctagtctttctattatattaatatcagtatttcattccatttattaattccaaatattaacacaaagattctcaacaccatggattttatctgacaaaatctagatattttagagctcatagtattcaaaataaaataaagtttaagtcttggaaagacggtcctggattcatttggcagtttttgagtaaaaatgagagaaaattatcaggaattcataagagatagtagactggttattcattatgagtgtggcattgaggtttaaaaagtacagcatggagatcaactaattgtattaraaattattaggaagatcagttatcttttatctttactaggttaagttgatgaatttgaggaacaaagtttcttcgttattgatagtaggatggattcttgttggtttttaataatcttctctaggattttagtagaatgttaatacaaaattgctttcatagaaccttttgaaaaaaataattctattcattggaacaccaaaggaattctaaatattcaaaattgttttaatcaaattctgttttaaaaacgactacagtggctcacacctgtaatcccaacactttgggaagccaaggcaggaggatcgcttgagctccggagttcaagacctgcttgggcaacatagcgagacaccatccctaaaatataaaattagccaggcatagtggaatgtgtctatgctccctgctactcgggagactaaggtagagaatcacttgagcctgacaggctgaagttgctgtgacctgtgatcatgccactgtactccagcctgggcaacagagagaaaccctgtctcaaaaaaaaaaaaaaaggactaatgctattctcaaattatttagaggtacttaaaggactaggaacagactccatcaaatatgattatctctgagaagtgagggaggcagggtggaaaacccttattttacatttattggtgcttttttatgcctttctgttctgacattttatttctatacatatgtcttttgtaataaccttaaaagacccattatagcagccccatgtgagccacgtgatggtatgtggatcttgttatttttactaaaattagataaatgtgccagtctgtaaatccagtgttattttgacaacattcatttttcacctctgttcccagcttttatatactcattagaatactaaagccttattgtatgattccttattgtctctatgtaaatattggcttagaagaaattaatgaaagcagaaactttatatttttatgtaataatgtacatacattattatgtattatgtaatgaacgtatgtatgaatgtwtgtgtgtatgtatgaaagtatgtatgtatgtaatgaaagcagaagtttacatagtttactgcttctgttgcagtctctatcatattttatgaatatataccaattatctcttaaccttgaatgaaatgtggaatggaaatggggcaatgtttacattgggggcagtactgataagtattattattattactaagggaaaaagaaaaatattggaaaaaatctttagaaagggttttattaattgacagcatgcagcatatccaaatacctgtttactggtttaaaatgtggaaaataatctgttacatctgagtactttttacttrgatttaaaatatagtaaaacatccttaaattattaagagaatgaaattgggggattggaggaatgggttaagtgtggtgctggagaaaacagcagtttctggagtgagtaagagtttcggcaagcctagcaacgttgccagcccagtgataccacaggctatatagattgaataacaatatctggcatttaactaagacagaattgggtcccaggagaagaatatgagagattgcttataatgaatcaaggcagactactcacatcaacacctaataaacaaagtcaggaactgtagaccaggaaaagttgctatgagagctttctaagattrctggaatgtatgctatttttctatgttagttttcttttctttagtaataaaattcttaaaccaaaggcctacctgttcattcttagaatgtttgaaaaaaagaatagctagagaaaaatgttgtatcttattgtcagtatagaagagaagaaaagctagcagaagacaactctgaggaggaacccaggctgaaactctgaggattgctgagtgaggaaaagggaccctcaggatcagtccaaggaccagaccctgtctgaggatgtgaccagaggggtttaacttgtgccttcctgactctcgctgttttcccccctgcagtggcactgtattggctctgtgtatggtagcccgctgtagtgattgtgctcctagagtagaacttttgatacttacagattgaatagttgtggtccaaactgttcccaaggtgctccttgttcaaaatgtccaccatcccttagccagtaactcctgtggagctctgtgttagtcattatgcatctggatgtgtccttcccaaatatcagtgatccaatcagtctgttcctgaattttgctgtttgcctttagcatagctctttccagaattattttataaaaaggccaacatttcttttagtagaacactctaaaacagcagaattatttagcacagtttaaaagtgattttatctttcccattagtgatattttttgtggtttttcaaaagttactttttgtagccaaaggaggcttgttagactcttcactcttaactatttaagtgggtgtggcagatttgaaactgtagtaattctctataaatgagggcatcactagttcaaaacwgttttctaatgatgaaattttttagattagccactaattcttaatataattaatgtaaaagctacagtgtttctattaatgggaaaaataaactcaagaaccatgttgatactgttattaatatgaacattataaatacctgaaggtacgtgcatataataaaactgataaatgtgaaaaagttctcatagctctctcaagatgacaaccacacagtttctgggttccattctgctcaaaatgggtttttataaatttatttaaatgaatcattgaattagttcttttgtttttctttttgttttttattaagacagattcttgctctgtcgtccaggctggagtgcagtggcacaatctcggctcactgcaacctccacctcctggattcaagtgattctcctgcctcagcttcccgagtagctgggattacaagtgcctgccaccacgcctggctaatttttgtattattagtagagatggggtttcaccatgttggccaggctggtcttaaactcctgacctcaggtaatctgtccgcctcagcctcccaaagtgctgggattacaggtgtgagccatcgcgcccggcctgaatttggttgcaataatacagaaatgcaagcacactgagaaragataatacataactaaggctaaaaatgaatggtgtgatagaacttcacttgcttcctggctgatttcagagaaccttatttgcagagcacagttggatctataaatatattatgaatgtaaattaaaatgacaggagatattatctcaccccagttaaaatggcttttatccaaaagacaggcaataacaaatgttgatgaggatgtggagaaaagggaactcttgtacactgttggtgggaatgtaaattaatactaccactaccactgtggagaacagtttggaggtccctcaaaaaaaaaaaaaaaatagagctaccatatgatccagcaatcccactgctaggtatatatcccaaagaaaggtaattagtatattaaggagatatctgcactgcagtgtttattgcagcactattcacaacagctaagatttggaaacaaactaagtgtccatcaacagacaaatgggtaaagaagctgtagtatgtaatcacaacagagtactatacagccataaaaaagaatgagatcctgtaatttgcaacaacatggatggattatggaggtcattatgttaagggaaataagccaggtgcagaaagacaaacttkgcgtgttgtcacttacttgtgggagctaaaaattaaaacagttgaactcacggagatacagaatagaatgatggttaccagaaactggtagtggtagtgggggtggaggggatgaggggatggttaatggatacaaaaaaaccagaaagaatgaataaaacctagtattgataacatggtaattataatcaataataatttaattgtacatttttaaataaaagagtataactggattatttgtagcacaaaagataaatgcttgaggagatggataccccatttaccctgatgtgattattacgcattgtatgtctgtatcaaactatctcatgtaaccaataaatatatacaactaccatgtacccacaaaaataaaaaaaagatactatggttcatataagtgaaaacttgaagaaaactctcatatgggaagaaacactttcttctctttatagttagggaagtcagtgctttcctgtgaagagacttttacaggatttcagttccttggataaaaactatstaaaaatcctctctgttcagaataggggaggatcatatctcagactggtgtaacatctagtaattgaatattttaaaattttatatacttagaaattcaatcttttatgagtagtagaattcttaagataagtgagtattaataaatgaaagaggtggttaatgaaaaagccatcagagtatacatataacaatattagaaacatgaaagcccaagtattacaaatgttttatgcaatacaaattgtactttgtcccaagtagtgaacccttaattaataatatttgtctgtattgacatatatacagtctgaaaaacaatactggacttatcttgagtgtttaacaatatataataaattgttataccacaatttggggaaagctttaaaatatataatggttacttatctaaatctctgtttatttgtatttgttttagtttatgatagaaataaagaactctgctgtatcttgtataccaactgattgggtaaaggttggaaggtaggtttaaaataaatttttttcttacaatgcattatgatgacatctgtatatctatgtgctactgggctcatcgtagccacattcttgaaattaaaagcaattctttttacttattttttctgatggaactttttttttttttggaggggatgtagtcttgctctgtcacccaggctggagtgtagtggtatgatctcagctcactgcaacctccgcctccctgattcaagggattcttgtgcctcagcctcccgagtagctgggaccacaggagtacactacaacccccggctaatttttgtatttttagtagagacggggtttcaccctgttggccaggctggtctcaaactcctgacctcaggtgattcacccacttcagcctcccaaagtgctgggattacaggcatgagccactgtgccctgccctttcttatggaacttttaaccaaggagatcattacttttaactctttatcattgattttaaaacatttttcaaaaaggtatcttatttttacacatttattttcttgttttgtaaattattgctttatttttatagcacagggtacacatggaagaaaagttgaggaaccttcaattgtaagattaatttagttgcttttacttcatggtgaatgctatgcctgacatttcttttaagaagctgcaatttcattttctacctcactgagctccacatttctttattcttaatgccttccttggcacataattattataattctttacatctttttttttgtaacccagatcatgaattgatgaaaataaattaatcaaaaacaaatttagagaaccacattgggactctgccttttctccttggttagatactaatctccargagaggactcatttaaagacaaggtattagggaagtatatacagctgtgaatagtatcttttgtggaatatttattagtactgttatcaataagttgcacaaacatgagatgaaaatggtacatttgcctcagatggtagaagagggaccgtagctggtaatagtgtacagacattctgttttaaggatgaagggaaattttgacataatgtgtgaatgattgttactttattacatatataatatatataatacatatatacaaaaaatataatacaaatatatatatatatatatatwtwttttttttcttttttttaagacagagtctcttttcgtcagccaggctggagtgtagtggcgcaatcccggtctactgcaacctccgcctcccgggttcaaatgattctcctgcctcagcctcccaagtagctgggattacaggcacctgccaccacagacggcttttttttgtattttagtagagatggcgtttcgccatttggccaggctggtctcgaactcaagtgatccacctgccttggcctcccagtaatttattattttaacttaaaaagagaatgtttattatccattgccacatcatcagatgttgaaggcacaggcatggatttctttcattctaataccatctttttttttttaatgctaccagaagctgtactttagatttgagtattgttgattctaggggatgttttctctttttgcaggcattctttcctttatctgtttttgtcctgtaccacagctaatgaatgaaatatgcattatgaagagaaattaccaaaaaccatgttagtctatctacaacaataactgaaatatctccctaaatgagtttttccagaagataaagctttgataaatatgttggcctagaagtctagatgatataattttaaagcaacaagcaaggcataaatcagtgacaccatctttcacatgttcagtaatgtaaattgaatcaacagataagatagttagggaaaggttcattgcagtttatctgtttggccatagggttttgacagagatgagttagaacatcaggagtcagattttgaatgcaaaaggcccacccctaatccagcaacttggcaaattaaagtgcaacagtgtattacaagagttggggagcaaaaaaagaccagacaccttgaccttttcttcttgaagatttatcatcataatgacagcattaacagcagtggcaaccgccaccaccaccaccaccacaaccacaatacttacaggcgctctcctaagttttatttgtttgatcctgtcaacagtacctatgaggtagatattattatccccgtttcatagatgagaaaagtgatatttagagaaggtctgtttcatttgccccaaatcacatagctagtaagtaagtggcaggactggagcctcgacctggcttctctgactggggacccatggcatcccctgttgtgctctagctactgaacagagagcagagatgatactcaagcccagatggggagcatgtggtatttcttcctatccagagccactgtgaatctgcacagatcacagtatcctgaagatctttcttaattgcctcctgacttaatgcattgctttctttgtaatgcttttttatttttcttttttcactgaaatacttcaatcatacagaaaagcccataaaacaaagaataatacaaccttcaccaatgtatctacctcccagctttgtcttattttcttttaccatatatgcttctgatcttttttaaagagcattttcacttagtataatttaaagaaaaaagctttctgcctatgaaataaaagttctaaactctgactttgctatatgggtataatttgaaatgcattttaaaaggcttcctgagcaaagtcatattctttggaatcagtagagttcaggaccataattaaagaatgttcttctgtttacagctgtttactttcaaggttcatcagagaataataaataactaattttctaaagtgatggcatttcggattttttactaaccttgatttcctatttgtgttctttcccctcttctagcacaaaagctgtgagccgctttcactctccttttattgtagaaaattacagacatctgaatcagctccgggagcagctagtccttgactgcagtgctgaatggcttgattttctagagtgagtttacaatgaaaaaatataatctgactttttgctatcagaaacagactggaaaaatctttccatcaaaaagaaaatagagattacagctcatgacccaccataaaatagttgagtacatgtgttctctgattttatttctttttttttttttttacttttttttttttgatactgagtcttgctttgtcaccgaggctggagtgcagtggcacgatctcggctcactgcatcctccacctctcaggttcaagcaattctttgtgcctcagcctcctgagtagctgggattacaggcacccaccactacacccagctaatttttgtatttttagtagagacgggatttcgccatgttggccaggctgatgttgtactcctgacctcaagtgatccgcctgcctcagcctcccaaagtgctgggattacaggcttgaaccactgcacccagcccgaaagaaattcttaaaatctactgaaagttaagatgaccckctatacacccttcacctaggttcatcacatgttagcatttgccacatttgctttttatctctcatgtattttttttcctgaaacatttggaagtaagttttaggcattgtaacactttacccctaaatacttaagcctacgtctttaaaaataaggacattctactatataatcttaacaccatttattattacatctaaaaaaaattaacattaattttttttttttttttttgaggtggagtctcactctgtcacccaggctggagtgcagtggcgcaatcttggctcactgcaagctctgcctcccgagttctcccacctcagtcattctcccacctcagcctcctgagtagctgggactacaggcgcacaccgccacgccctgctaattttttttttttgtatttttaatagagacggggtttcaccgtgttagccaagattatctcaatctcctgaccttgtgatgcgccctcctcggcctcccaaagtgctgggattacaggcatgagccactgygccggccaaaaaattaacattaatttatgaatatatttgaatttcttgaattttcccaatgtccccccgccaccggctttagattttaaaatgaaagacctaatcaacttttacatgttgcatttggtaattatgcttctttagtctgtttgaacctagaattatctgccacgttttttgttattttaccatggtattttttgaagagtccttgccattgtctcaaagaatgccttatattctggatttattgatagtcatgtgttcatattggcagttttaagtcatggcatgctggccaatgtttaacagccagctctttggaaggacagtcatgtttgtagagtttgctgatttctgtagtgtaaacactcccaccagggctgatgtcaagctaccactggactggagttgggaagagatgtacacagttgattttcatgagtccataggaaccagctctagaccaccactggtctgagtactttatatataaactcagtatttttcacgtgacccctgtaaggctaagtatcatacccaacttacaaatgaataaagtgagatgcagaaataagaagttaatcttccaagggtaagggttggagcccagattcagccccagccatccggcagccagatgtctggcctttgccagcctgcccatggtgagcctgcaggcatcagtctaaatacatctgttagtctctcactttaaaaccataaacaggccaggcgcagtggctcacacctgtaatcccagcagtttgggaggctgaggtgggcagatcacttgaggccaagaattcaagaccagcctggccaagatggtgaaaccctgtttctactaaaaatacaaaaattagccgggtgtggtggcatgtacctgtaatcccacgtaactcagtaagctaatgcacgagaatcacttgaaccggggaggcggaggttgcagtgagccgagattgcgcctctgcactccagcctgggcaacagagcgtgactgtctcaaataaataaataaaaccttaaacagtaaaaattcagtgacgtccttcagggagctttattgtatttcaagtaatcaacccgacaaatgaaaaaaactaaaaacaaaaaagatatgtgagaatttttacaagctagtaagttggtatcagtcttttgccctgaggagtcttgaattgtaagaccaggaagagattccaatttacttaaatcttttgagactagcttgactcagagtcttgaatggagggatggaaattttgtctattcagtttcttttctatttcacttttaattttctattttaagggttttcagggcctttgagtgtttcagttgtcctggctttttccttagtattaccactgagaatgtgaaaactgaactaaaattacacctttcagtcttcaaggactcacattctagaagggtcctgggatttggtkaggtaatttcatgttcattctattcagaccttacataatttcatagatctggcttctattctcttgtcattattccagactaaagaaagttgaggtctcccaggctaatcatcctggtgttattcttgattctttcttccttttggtccctttatctgttaccaagttctttttttttttyttttcctcgctctgccacccaggctggagtgcagtgatacaatcatgactcattgcaatctctacctccccagctcaagcaatccttccacctcagccccctagtagctgggaccacaggcatgcagtgccacacctggctaatttttaagtgtttttgtagagacagggtttctctatgttccccagcataatcttgaactcctgggctatgtccaacctgttatcaaatttctgattgtctttttccccctttgaggtgtttctttgatttgtcccttcttctgttgtcttctaacagcccattattacctcaaaccattcttactgtattggccttctgactgggccttctactaggttgacccaggagtttttattatattatccctaggctgtaattgagagttgcgaagagtgagctaacagtaaatataacatcatagaagcatatgatactctaattactaagtgaagaaaatcatgtaaagtaaaagtatgatacagttttatatgtgtatatttacataatgcacagcatacagacttttatatttttaaagattatatatgcttattattgtattactaatatgcttattggccatgtgtatatctttggagaaatatctattcctatatacatatgaacatacatacatatatatatgtatatgtagactcaaaatgttaactgattatttctggatggtgaggttactggtgattttaatttctttactttgcaaatgcagttggctcttgatatctgtgggttctgcatccatggatttaaccaactgcagattgaaaatattcaaggaatgaaaaggatggtagcatctatactgaacacatacaggcttttttttccccttgttattatttctgaaacagtacagtataactgctatttatttatagcatttacattgtattatgtgttataagtaatctagagatatttaaagtctatgggaggatgtacataggttatatacaagtactttaccattttatgtaagggatttgagcatgttggattttagcatctgcagggggtcctagaaccaatcccctatggatactgagggatgactgagcatgatttcagaagttcctataatgtacatatattactttcagaataagaaaagtgtattaaagtttttatccagaaaaagaatattggctgaaatttagctagagcattttgcaactagagcccccacttgagagcagcattgattgttatgtacactatttattgasgtaccagatggtgtgactatgatatcattaaaaaaatgattaacctcaatgaacctgacatcagaggattgaataccagcattacaaatgtatttgtcacttactgaggtactaactgttgtgcattagtcacattacttttgatcaaaatgttgtcagaaattaaggctgtagacactgctgtggattaaatcctcccttgaaacatgtctctcttttttttgttctagargatggactgtgtatattcagtaatcttctcaattgcaaattatttaaaaattgaattatatcataaaaaattatagaaattcatttgcaaatattttcaatttttattaacttcagatatcattgagcaacacttcatggtaaacttctctagtcatcataacactataacagctttagaaccaaagtgtcttcatctgcttcctatggacccagcaatatcttttggccagaggttaaatcatagtgccttgacttcatccttaagttggttggtagcatagtgataaaattgcttgttgttatgctataaacccagtctaccagattgttatctgcattgaccatttttcagcttaccatttttctaagtatggataatctctttgaagtttggcaaagtgtatcaaatggacaaagaccaagatgtcaaacaagccttctttaagagttatgatgttataggtttatgatagtttttcattttattcatgtcttatttataccattgacatcagaaagagcattgttgttcatatcaaaataattacttatcccttcttgcttttttgttgttttaactgaaatgggacccactaagagctgtgttaactcatttccatcttaagaattagatcatcagagatagctaccctcaagtcaagctgctgagtagtagcaaattagagtcttgaggacctgggcaggacctgagaaggaaggaaagagtgagaaaaaaattgaccatttgttactgctaaagctttgatactcatgtccagagaggcaagggcagaaataccaaatatggctgctttctggcaaaagagagggtgcctagataggaggaccggatgggtcagtaattagaacaaagacagcatacgccacagtgcaagagggcaacaagtggtcagatctaaagtcagagccatggctgacgcagtggctcatgcctgtaatcccagcactttcggagactgagacaggtggactgcttgaggccaggaattcgagactagcctggccaacatggggaaaccccgtctctactaaaagtacaaaaatttgctgggtgtggtggtgcatgcctataatcccagctactctggaggctgaggcaggagaatcgctggaatctgggaggcggaggttgcagtgagctgagatcatgccactacactccagcctcggcgaaagagcgagactactacgtcgcaaaaaaaaaaaaaaaaaaaaaaaaaarggaaawaaataaataaataaataaagtcgaagccagagcaggaataacaaggcaaagtcagtgggcacccactcgggtttagggtgactcttaactctaaacacccagggcagttaggtcaatgcaacatgtggcatcttcaaaactagagagcattttattttgttttattttattaaatgtttgtgggtatatagtaggtgtatatatttatggggtacgtgagatattttgatacaggcatgcaatgtgaaataagcatatcacggagaatggggtatccatgccctcaagcagttatccttagagttacaaacaatccaattacactctttaagccactccaaaatacacaattaagctattgactatagtaatcctattgtgctatcaaatagtaggtcttattcattctttctatttttttggacccattagccatccccacttccctccacattttaaagtggtgactgagggctgcctgtctgatgctaggggcctgtccgttttgtgtttgtggttttgcacagattctaacactgttggtgggaatcgtattatttgttttgatgaactttaattcagtgagaartagataagttatattcattatgttctrtctactcagtaaataagtatacagtatactgtgaatatatttttcggttcacaaaaaacagaaataaagctggatagttaaaatgttgtttctagtatctggaaaaagtcatttatgtacaataccttattctaataatactagaaatatcagaagttacagttttaaaaagtcataatgattatataggaatagtccatcattctagtagtgtaatctggatatctttttcaagctaggaagcactgtagaaatctttggatttcagtagtaaacagactgtctcaacatttctgaaacccacactacaatagagaaatgtttttaaagagaggcatttattgtccgtttgttgtctttttcacgtttttggatcatctttaaaaggtcgtacagaatatctgagctacactattttttaaatgtagaaagtaggcaccttctgatccgtggtcagacgcgttacccattgcgctactggccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaaccattgtggaagtcagtgtggcgattcctcagggatctagaactagaaataccatttgacccagccatcccattactgggtatatacccatgacccagccatcccattactgggtatatacccaaaggactataaatcatgctgctataaagacacatgcacacgtatgtttattgcggcattattcacaatagcaaagacttggaaccaacccaaatgtccaagaatgatagactggattaagaaaatgtggcacatatacaccatggaatactatgcagccataaaaaatgatgagttcatgtcctttgtagggacatggatgaaattggaaatcatccttctcagtaaactatcacaagaacaaaaaaccaaacaccacatgttcttactcacaggtgggaattgaacaatgagaacacatggacacaggaaggggaacatcacactctggggactgttgtggggtggggggaaggggggagggataacattgggagatatacctaacgctagatgacgagttagtgggtgcagcrcaccagcatggcacatgtatacatatgtaactaacctgcacattgtgcacatgtaccctaaaacttaaagtataataataattaattaattaattaaaaaataaattaaaaaaaagtaggcaccttatttctattttatttctatgtatgcacaaaaataaggcaagatgctagtaggagtctgtaaaattgcactgtgaagtagggtgataggaagagcacagtttgagtctaggctcaattgctttaggctaactgctttttctctctgaacttcatttgtaaaacttaggtaatgaagacctacctttatggttgttgtaaagaatatgtagtggcttcttcgtagtctttgattagtaaatgtttgttttcctttcagctttccttttggacctatttacagttagtttattacattttctcattttccagtctttgaagaatttgtgacttatcaccacctacttaaacattttttgtgcctcttaatctctcttggaggcagagtagttactataaagatttaagctcagctatatatttcctgttacttaaaaagatactttatacttggccattcttaaaaattaagttttgggtcctttttgtagtttaattatgtacacttcacacatccacaattgatcactacatacagatgtccacaatttatacgacactacacacattgacataaaatactatgatatgagataatgggataatttaagaaaaaagaaaaaagtattcatgtatgttttctgaataagtttttcattaaaagccatttaggcttttagatcaataaatattatagttttaagtagccagagacttgaggcaatgaccattatcttttaaaaaacaaatctgaaatttagtttttatatgcattattaataagataactgaagataagtgaaaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggagaagcacaagggaagctgatccacatgaatatttcatgatgttattgaagcaaaatgaaaatgactgctatatttatgttatatcttaagttcaaatgtcagggtcagatgaaatctgtgatatattcttaatggttgatatctttacatagaagttgttttaaatttatatacaaaacagaagcctcaataatttagttattatattaaaaagtaaagctgtttggtgtaatctccatctctcttaactgttaggaatgcctgctgatcatctgtatgcttacactagctgataaagtgattgcttgttgtagagctattataggtttaagatatcagtttgctcacctttttgttgttgctgctgcttccgtaggaaattcagtgaacattatcactccttgtgtaaagcagtgcatcacctagcaactgttgactgcattttctccctggccaaggtcgctaagcaaggagattactgcaggtaagatatttttcattttcctctttatcagtgctttagataagatgacattattcaattaattatagtgtctttattataaaatattacagttactcaaatgtgttagactcttgggaaagctgaatgtcatacatatrtagcttgatttgaaaattaaattcatttcttgcttcctctgtcactgagtacaatgaaagcagatgttaaagtttatgtgggtgacatttttataaagtttcagcactcttttcatttgttagcttttacttgaacacttttataattataaaagtttgattaggcaagaaaagactgagaagatagggactgaggggcattttagtgatctgttccttttgttaagagcccatattcatcccactattctttattgacctctaaacatcccaacatggaatatttattctctttttcataaaggatgttagcacaaacaaatctaactttaaaattcagatggctgggcgcatggctcacgcctctaatcccagcactttgggaggctgaggcaggcagatcacgaggttaaggcatcgagaccatcctggctaacacagtgaaatcccatctctactaaaaatacaaaaaaaattagccgggtgtggtatcacgtgcctgtaatcccagctactcagaaagctgaggtgggagaattgcttgaacccaggaggtggaggttgcagtgagccaagatcrtgccactgcactccatccagcctgggcaagagagtgagactctgtctcaaaaaaaaaaattttttttcagacaaaactttcatacaagttgtatgtcttccaaagcttgattttatatatacttaagaaaaagtaagactaggcttggtggctcatgcctgtaatcccagcattttgggaggctgaggcaggaacatctcttgaaaccaggattttgagaccagcctgggcaacatattgagaccctatctctacaaaaattaaaaaattagctgggcgtggtggtgcacacctgtagttccagctgcttgggacactgaggattgcttgagctcagaagtttgaggctgcagtgagccatgatagtgcccatgcactccagcctgggtgacagagcaagagcctgtctcaaaaaaaaaaaaaaagagagatagaatttaaaaaatacaaaattaaataaagttgttcaagttcaaatgttttattctttccaggaggcatctagattattcccttcactgccataggtgtcatcagtatgctttcttgctatgcgtgttctatcctagtgtatcctcccagctctgtgagttatcctttgcatcctattctgccaggaagcgttttgtcattatataattttgatagcaacagaataagtcgatgtaaattttagtgcagaaaaaatcacttaaaattttgttccaaagtgaaaatcttcctggtaaatcatatcagtgtcatgaatattatataatgatttcacttggcagagcacctaggattttattttaaaattaatgtcacaaatactttcatttttttcttttacaatgaatttgtaacccacctagacaaaaaatcttgtcttcagaattacactctaaaatccaaaaactatccttttttcataattttaagtgtctctctccaacagatgatttcaaagtatttactcagaagacactgtagtcactttttttttttttttttcctgagacagagtctcactctgtggcccaggctggagtgcaatggtgcgatctcggctcactgcaacctctgcctcccaggttcaagggattctcctgcctcagccccctgagtagctgagattacaggcgtgtgccaccacgcctggctaattttcatatttttggtagagatggggttttaccatgttggccaggctggtcttgaactcctggcttcaagcaatccacctgccttggccttccaaagtgctggaattatagacgtgagccatagcgcctgtcctgtagtcactttctttgcaaaatgtgagagcatctgggattttattagccagatatatttaagaagaataatttaggaaagtagtatttattggtgttatgagtaagttcagaaatgtggttacacatgaaagttctgagtcaaagaactataggaggtcattggtaggatattatgcttttgaaaaaagaccaatgaatcaccaagaaactgatgaaaagatgttcaatcttagtaatcagtgagtgcaaattaaaacaatgggataacgctgtttacctgttatgttgacaaacattagaaagtttaataataccaactttaagtgagggtatgagaaaacaagttaactttcatatcctgcttgtaggaaagtagattggtatatctactcttgtctattaaaataaaaaataagcatactctgtgacttaggaatcccactttaaaaatttactctagctttgggaaacacttggacttgtacacgtggagatgtgtataggattgttcattgcatcatcgtttataagtaagaatttggatgcaatctaaatgtttaacagtggaaaatgtgtagcagctttgaaaatctgacaagaagtgatcttcagtatactctactgtaagggcctattgaacctaatttcagtttcttaaaggccatctaaagaacaaagacgaagtttactttttttcctttaaaaaggagagtaaaacttactctgtcttacacttaccatgtgggtttattggattgttttataaatgtaagatgcattttgggatctttagtgatcttattttttctgtatcttggaacattttgttatttcttcatcctgagtattgttttaacattgtttatcatttgtttcaactataatataaaagtctaaaatgaaaagaaaatgagagaatgatgatgcagaagtgaggggagaaatcactatcacgtcatccttctgttttcttcttgtattgcccgcattacatcatcttccaagaaggtataaaagaagagtgcagatgccacagttggagtctgcttctaattttcattgaacacagttgaaaattcagaatttttcgttgttcacccgtaaaggcaaagagaacaaaattgacagaaggcctttcataattattagcttaatcagatgatgaatgtgaagagaaaaaaaccagtgccctgcatattcatggtgatggtgaaatttcatgtatcagcaaaatctgagattctgaatgctcagaaaatatcctaggtgaattttctcaaactcaaaagttggtatgtgaataatatatttgtaagggcaaaatgaactctgttattctcgtccagttagtcattcaataggaaacattcatcatgtaatatttggtgacaagaacctggactgtcctgttttgctgaaagatgtgatagtattcttctatcttttataatatttattcactaaaatttacttgatacaatttataggttacaatttatagacagacaggagattgaaaggatatagatgatgtagaaataaaggtactcatttgattattctaattggtgttgataagtcaaaaaatgaaaatattttgcaattatggagcaaagatgaccatctctttaagaaaattatgagctttaaaagatttcaaaaacttcttcaagtatttgcatttttgttgatacaaatgtgaaaagaatcagaaataatcagctctagaacctattagaaatgtattgaaatttggaatttartatttatgaatgaatatgttcyagatgcatgcttgacggctgatgagcaatgacattcagaatgtcttacccatttcagatatatatgccttgaaaaccaggagaatatggaataaaacttttgagatttgctgtgtttaaattcttattaaaatttgtcatgaggttgattttttttactatccccttattctcatttctgtaaaattatttgtgaaatgactttaaaggaatatattaaatccagatagtaaatggtgaaatctattttttgtgtgtgtactgagagttaaaataaactttgaattttttaagttacagaatgatagattacagtatgacttttccaaagaaatcacaacgagtgtgatgcatacataaacataaatgcacagaagaaggttggaaagggtagacaccaagctggtctcagtagtaacatctgggaaggagagctgagagtagggcagggctcagaggtgcttgaatacacagctaaagctgtagataaaacagatatagaggtctttaaaaagcataaagaacatcaaggtcaaaaaatgattcttgtatcaaagtaaaagatacaaaagaccgtagaaagatgttttaattgaacagygtatgaaaattttaggtcatttcatttccaagtccaacacatagtttatattaataattacatctagaaataattttatgtgatttactttattgtattcattaatgaaaataagtagcaataatctgaactgttatctttactaatgaaaatattggtttgatctcagacaacaatagaaaaatgaagaataaagcccagcatggtgacatgcacctatagtcccagcctcctcaagaagctgaggcaagaggatcacttgagcctaggagcttgaggctgtagtgtgctatgattgtgtctgtgaatagtcactgcactgcagcctgggcagcacactgagaccctatctcttaaaaaaaaaaaaagaaagaaaagaaaaaaaagatcttgtaaaggtaaactacaagggtgaagccatttataagactcttctaaagtatgtgcttcagtgcactattataataataaatgttttcccaattttgatcttatagttcaaatttaacttttatactcaaggttttattctggacatatgttcttaaaatctrtgtttaaagttttgttttctgtcgtacaaacagagtactgaaatttttcatgctatcttagagttttttttttaaggctatttccatgcctagtaaattgaaacatatttcttttttgcagaccaactgtacaagaagaaagaaaaattgtaataaaaaatggaaggcwccctgtgattgatgtgttgctgggagaacaggatcaatatgtcccaaataatacagatttatcagtaagtaccttatgccaaaaaataagtcgatgataacatcccaaacttttacataccaaagaaacatttttataattaaaagttacccaaatttcaactttggctttaaatgggctaagcctggacatagttttatatttaccacgaaatgtggaattggtgctatttccaatgcaagattatcaataggtttagtaactaaaagtttagttctaattagttatcctaggtaacccaataaaaatattttacatttgtaaatacccaatatgcaaatagagttggaattataccatagttttgcaaattcatgttagcatgtagtgttccatcctttgtactgtgactattttcagatrttctatgcaagaatcagagatgcctttgcagattccagtgatgagaattttcattataggggctggatttctcttacataacacaaatgatcctgaatacttaatttacttaacacatacttactgagtgcctgtgtctcaggtaatgaagtattaggaacagagactagtaagcaagacagaactcttccctgccctcacagagcttgttgtatagcagagaagataggctagtgcaatacagcttagtgcatggcatgatagaggagaccaggatggcctggggataggtagcaggttggcctaacccaagggcagggaagcattgaggaatgttccccagggaggagataccaactgaagaatgagtcagtgcaggccaaggtattgaaggggagtattccaggtagaagaaccagcatggcagatattggaagtgaagcatagcaggaggaattcgaggaactgaaagatgatgagtaaggttggagtgcagagtgtgaacaaagaagtgttcagagataaggaagaggccagttcactcatatcaagaaatttgcatttttacccctaaaagattaagaatactagcaagagagtgatagaagctgggtaaaaatagtgaagttatggcagggtgtttgagttccattgtcaaagctaaatggagctgggcactgaagtggtaaggattgatcttattcagtaatactcctgcatagggaagagtccagtgtgaactgaacttgacttcattttggcatagatgactgggtgttttaaagggaatacgagggaacagggaaagggaatgagctgggggaggagagagagtgaggtgtggttatttgaaacctatctgggtttactaattgtttgcttataccacatttcaaagagtcagctctctggtccttaagaagacaattctgggtgatagatttacatcacaaaggggcagaaaaagtatttataattgcaagctttctaaggtaactgttctaagaagggcttcagcatctggctgcctgtcaccaaattttggctggaatggcgaatcctggcagcactgagttttctcaggcagatacttttagtggggctggggtcatcctaaggatgcagccttgagctgttagaaactatgctagtggggtaacttctaagtagggagggtggacaaaatcatttttactcaaagtctctaggtttttataggtcaaagttgagaactagtccagaagagggctcagagaaaaaacctgatgagaatttggtcaaggacatggggtaaaacggtatggtgatgggtcaaaaaatgaatatgtagggagtagttatgtgagagagaasgtatcagagaataaaatgcctgactttcagatatcaaatgtgctgtttttctggttgatggcaagatcttatgtatggctatggaaggtgggtagcagaagggagaaggtctttggagatgaagagatcaaggaacagagtttgggaaaaagttgtccatgtgaatgttgaaatctaagataacagcaagatatgccatagaggaaaacagggatccaggtgtctgagattgcgagaaatggcgattgggaatcctgaagtttatagatagcttagattgaggacagacagtggtaaagccctaaagaagagcttctgaaccctgaaccctgaggtacatggtccatggtyggatgtggcagaaaggtcagcgcccaaatgagagagctgcaggggaataacaaacagccagccagttttcattttagtgtatgaaggaaatgttaagcaaggtggttagaaacagaagtactaaggaactcttctgaggacagtgaaagaattgagatgtaggggagcatttggaatgtagatcagagaaagctcagagtagtagcgagctgggactgtaacagagtattctacctygggctgtgagcagaggtggcagagatgtgtggcatggtgcatttggctggccatgagagggggatgtgaagggaaatactttgaatgacatctagtttaatttataatatggattttcatatcataacaagacttgttggtagtatataatgcatgtcttagtctgttcaggctgctgtaacaaaatatcatagactgagtagctcataaacaacagaaatttattcctcagagttctagaggctggaaagtccaagatcaaggtaccagcagattcartttctggtgagggcctgtttcctggttcctagatgacacctcacatggtggaatgggtaaagggtctcttactcatgtattcacacagtggaagggataaggggtctctctcaggccctcatgaacttgtcatctcctgaaggccccatcttctaataccattgccttgagggttaggatttcaacatacaaatttgggagagagacaaatattcataccatagcaacctaagacccaatgtctataaacttgttcattcttttttaggaaatttttatatgtggtagtcaaacaagttaataagtaccaatctttttattgtctttaaaaagaagactatgtctttgagaggccgaggcaggaggattagttgaagtcaggaggtcgagaccaacctggccaacatggcaaaaccctgtctctactaaacataaaaattagctgggcatggtggcgcctccctatgattccagctactcaggaggctgaggcaggagaattgcttgaacccaggaggccgctgcactccagcctgagcaacagagtgagactgtctcaaaaaaaaaaaaaagaagactatgtcaacataagaattttttttttcagttctcataataccagtaggatatagcttttcttgagaaagtaatataagttaaatataaactaagcaactaaatattagaactataagtttcttaaaataatttcctgttactgtttccctgcccatctacttgacctcaagaatattacccttgggattgacttatttctttttttctttcctttttcattctttttctttcaaaacgtatgttacactttaataaagcaagatttgaagaactaaaatagccttctgtctaattacaataatgttttaaagaaacattgaactcttacatttaaatctttacaaagtaaatggagtaatttttttttcaagcaggcacctcagaatattccagaatattcgtttctattacatatgctttttctaacttgagtaggagttgatatagaactgttgctatggtgaagtgcattctatttttcagggtaaaaatttatatatagggatagtgttgagaaagaacttacgtaaaattcaatttaaaatattttatggatgttaattataaaatataccctgaaaataatttcaaagttaaatgacattgttgtttttgataatcatgtggttttaagaactggtgctttgtacatgtaactataagtatacttttctgtattctgtattacatgaacttattatagtgcttctgaataagccaactttctgcccgcttttcctctcccagttttaagaatactttttaaaatactctttctttttgtccccttccttgattcactatataatccaagcatttatacatgtggtcaccgctggagctccctcctccaccctgcccacctccatggattctctactctgcagccacagggcttctggaacgtgccatgccactctcccttttgaattcatacttcacactccagccagattggacttcatgccgttcccaagtcactgtgcctctgggacttggcagatggttttccctctgcttagaatgtcatctttccccaccccacccactcccgcctcacacactccaacatccacccacccaacacccacccgactccccagctctggcttgttcaagtcttgccttggatgtcagctcttgcactcagccttcctttgcccagctgggatgggtaaccctctcacataccctcgccactctatttctccacatctcagtacttattccaccaaattataatcattctttttttatctgcctttcccagtggactgtaagcatgaagagaacagggactacatctctgtcacctatgtgtaatcccaggatcagtcacagttctctggcacatagctggcacctaatcagatttaataaatcagtaaggattagctagaagccttcagcagtctccaagtctcacttgaaatttttgccttttattttctacacaaaatgttttttttcaggatattatatggggattgccccaatttacagaataattttactgtcaaactaaaagggaaatttgggatcttttagtgtaaccacgtcttcatacttctgagtaaactatggttcagaaaggggaaatgatctgccagaggttgctcaggttgggtcgtcttgaactgtttcccaaaacataaacatattttaaggcaagccagtgctttccaacctttttcactttgcatcacacagaaaatgatagtattttaatggaacactggattaaaaggagaaggaagaggttgctcagaggccaaggaggctggcccagggactgtggccgccccagccccacccaccacctgtgggttaaggggtcagtatcttggcacccctgtcaccttgtgaggcagcccaggactgctgcttagggaaaccccagcgaacccactgcaatctcaactctcccaggattgtttgttaaaccaaatgactcttttttttttagtggatggattttsaacagcagttaaagtcggggttttcagttcatttgtagggtttttgtttttagtataaaaaatataaatttcaactaatggaggggaggggaaagagtggttgacagcttctcagtttgttgggtgggaagaaaatgagtcaaacgtgcacaacaggaagattcccaggaagcactcgaaccctgtagctctctagcccaagcagaattcacagcccaggtgttttattgctggggcagggtagacattgagatgctagtcacagtcccttcttgtgagatcaagatgggcctagggtgcttcagtcattagctccgcatgtggtatggaatgggtgctcacacatttgttacatgaacaagtgcttgaagctggtaaagatgaacagatttcccaattccttcccttatctcagtacaaataatgtctagctggcccagaaatacttgctttggctgtataaaagtttaaaagactagttacagtaatattcataagctgttgacaatttgtgcctaattaccaagtggaacagtaataatacataccataaaatatgtctgagctttaagcttaatttaattccatggctaaattatattctcacagattctgctgtaaaggtgtttttcacatagcatgatctttgaatcatgagcccatggattaaaattctaggaaacattaatggcaattgaatattgttttcttgtcagtcctttcctctggttctcctctctcctgcttctgaaacaatggatagagaaggacatttgtctgataaagtgttctgacctgcactgctgtctctgcccagaatggccctcccctctcttcttatctcttacctgtctgcattgattggactcacactgttcctgcaggacccaacaaaacactgcctcttcctgagagccttcaccatcctctggccagaaaaaatccctttctattcaagcactttctttgctctgtttttaaagctctcacatactacttttgttacacaagtgtagtgggaaagtggctcacaatggtaggagatttaaattaaaatcctgctctgctgtcatttcactctcattttggatagaccacgattacttgctgggccttagtttcctcatctgtaaaaggaggtggttaagctgggtcacagccagccctcacacccaggggaatgtaaattgggcaggatccaggtgttggagggatttaagtcctgactttggcatctcaacatgcagctggtgccgctctccagcttcattttccctctttctgtttctagttcaccttgggttaaaagtgcaaagatttggctgagagctcgtctggaggaggctttgactcaagagtctcttaccataacctgctgttgattgacattttcgaggaataaaacactttgaaactaccaaactttttcagcagtctgcagctgttataaaaatagttctcccataattcttctttaaagacagttgtcaatatttatacctgtcaaggaagatagcacttttttttttttttttttttttttttttacagaaaattagcttttcaggtcttaraaattaacatgtgacagttttattttattttttttctgctgtacatctgctgacttcagggatattatgactgtccattattctagtgtactcaatgatgaacacatggagtgaaagcatgtcttctcctatttagtagtgactatgattccctgtcattgagcaagcgtccccattgagacatgtcagaggatgaacttcacttaacattccagttctgcgacttagttgctgggaaagatatttagctttaggcctctgtttcctcacctgtataatgggaatccagtaatattagtattaccctgtgacattgttgtaagaactaaatgaagtgatacatagaaaatcattagcacagtgcctggcacttgttatctgtgattttcttaagatatcttgaagtttgtcttttatttttagatcttctcttcccccacagaagttgacattctatgtggaagttgcttagttatcacaagttttgactcactgtttagatactggataaacaatactaagatcttattgattgatgctattcagacagatattgccaatactaaagggaacacttaatagaatgtacttctagtctcttcataggtttgccaaggcagtcctctctagttgttatccagcaacatagtcccttcagcgcaatacttccagcttttgtttgctatcattaattaattcattcatccccctttagtttcttgagaacttgctctgtgtgtggcctccttaggcttggtgctagcccagctttgggcactgtctaggccagtctggtattcccagtaggctccagagtgtgtggagaggtggttattgccaactttcagattctggctatttggttagaacattcactcatgctaactggtcctgccgatagattttatgtgtcttttatatctgggaacccttgatgtgtgctgcctcaaatacgcacgatctttctaaaagagattagcacattagatgagtgaaatttcttgaccatttccttacttattgtgtcatcttgggaaccgtggaaacaagggggtcatatattcttgacagatttttatagagaaagcaaatgattgtttttgaaatgtaaacatggtggaaatctctgctgtaatgccttttgtgtattacattcatctctttgatctatttattgggtgccttctttgtgccaagccttgttctaggcaacggggatgaactagaagacacaattcctgctctcatgagaacttactttctagaagtgagattggtaataaataagcaagaaaattcaggtaatttcagagaaggttgaaaacaaaataaaatgggctgatgtgatagagaatsacagagcagaggggcttctgtagattgggtggtcaaggaaggtgtgtcctgggagttgatgtttgagtgtagacctgtagaaaggccttaaggcaggaatgagcatgttgtattctggcaggtggaaggagagcagaaatcaagtctggctagcaccaagtgaacatggtggagggtggtagaagaatggatcggaggcagacatggcctttagactgtgacctttagacacttagaagtgctctgaggatctggatgagggcttttagcaaaaaacaagttctgttttactttttatgacagtcactctggctgccctatggagagtggattgtgggcagaggagaagcaggaagacccagcaggagccactgcagtcacctgcctgggcagtggcactgggcatggagacaggaggttttatttacctagaggacctcctgattcttcagtcttgtgtcttttttcctgctggtgtttactagagtgcctgatgtacaacttatctcgtgctggcagtctcttagggcttactaagaaagccaccatgttgtcacctacaaatatttgagtttagtgggttgaacacatttaacttctaaagccttgaagttagttcttctttgacatcctcaaatcctggggcaggggtggtgggggctggaaaaaatctgtctctacaacagtatccccaagtctgcccaggttcaccatgcaccacttttcccaggtacttcatgcaaacgaattccacaacttctcatcttccaagcaaatctggcacagagctctggtgccaatttaattcctgctctttcattccacccagggccacatattcaagcaatgtacctgaatttaggatgagagatcttatttaattcaactccctgattttagaggggaggaaactgaagcctagagaggtgtattggcttgtccagagtccacastagaaaccacctttcttttgtgggccaattctttattcatgtttatacttttattttcacactctgttattttcttgcttatcaaggctctcatagaaattgacgccacagtgaaaatttttgtataatacttgacatagtatgcattcaatgaacaaatggttgttagtactctcattgctgtagaatccatttacaaataagtgttagattaagatttgaaatataaagaaagggaggaaattgctccttaattccaaagatagccactgttaacattttggaatgtttcctttgtctttctttgtaattttttttaagaaatagccattttttatataaaaatttttatatcctgctcttttagttaatattataacatgaatattttcctatattcttaaaaagtcttaagataacttttaatggcttcatggttttcaacaatatggatataccataattgccttaatattttctctgttgtatctactctttgctgtcatgaataatcctgccatggtacctcacagaattgattctttaaaaaaamaaaacaaaaattgggggcacatagtaggtgtgtatatttatggattacatgagatattttgatacagacaccgaatgtgtaataatgttaccctcacatgagggtaactggggtatccatcacctcaggcatttatcctttctttatgttacaaacaatccagttatactcttagttatttttaaatgtacaataaattttgttgactatagtgaccatgttgtcctatcaaatactagatcttattcattgtatgtaactatatgtttgtacccaaggaccattcaccttcttcacccctactacccttcccagcctctggtaaccatccttctgctctttatctccatgagtttaattgttttaattttcagttcccacaaagaagtgagaacatgcaaagtttatcactttgtggctggcttatttcacttaacataatatcctccagttccatccatgttgttgcaaatgacaggatcttattctttttttatggctgaatagtactccattgtgtagtgtaccacattttctttgtccattcatctgttgatggacacttagtttgcttccagatcttggctattgtgaatagtgctgcaataaacatgggagtgcagctgtctcttcaatatactgatttcctttcttttgggcwtatatatatacctagcagtgggattgctagatcatgtgttagttctatttttasttttctgaggacctttaactcttatccataacagttgtactaacttacgttcctaccagtagtgtacaagagttaccttttckccacatcctcaccarcatttgttatygcatgtcttttgaatatgtcattttgactggggtgagatgatatctcattgtaatttcgatttgcatttctctgatgatcaatcatgttgcacctgttcatatgcctgttgtttgtatgccttcgtttgagaaatgtctattaagatcttttgcccatttttaaattttttttcagtttttttcctgttgagttctttgagctccttgtatagtctggttagcgttcctttatcagatggatggtttgcaaatattttctcccattctgtgggttgtctcttcactttgttgattgtttcttttgctgtgcagatttttatttaataacttgatgtgatcccatttgtccatttttgctttcgttgcctgtgtttgtggggtatttctcaagaagttattgcccagaccagtgttctgaagattttccccaatgttttcttctagtagtttcatagtttgaggttttagatttaagtctctaatccattttgatttgatttttttacaaggtgagaggtaggagtccagtttcattcttctgcatatgggggtattgaagagactgtcttttccccagcatatgttcttggcacctttgtcaaaaatgagtgcactgtaggtgtgtgaatttgtttctgggttctctattctgtttcattggtctctgtgtctgtttttatgccagtaccatgctgttttggttatatagctctgtagtataacttgaagtcagataatgtgattccaccagttttgttctttttgcttaagatggctttggctattcagatccttttgtgtttccatataaattttaggattattttttctatttctgtgaagaacgtcattggtcttttaatagggattgcattgaatctacagattgctttagttactatggacacttaaacaatatttattcttccagtccatgcatgtggaatatctttccctttttgtgtgtcctctttaattttttgcattagtttatgtagagccctgggaccttgaatgaacataggttgtagtcagacagtggtcaccatgggccttgggtgagacccagtgttgtgatggcttcaggtctgacccagtgagcattgaagaattaggtatttattgtagccttcacagtctagcttgtttgtacttgttcttgggaaggctttccaagtattcaaagggacttgagtgttctgatctaaatctgtggtcactgcagctatgtctgcattagggggcaccccaagtccagtaatactgtagctcttgtagactcttwgagttaccaccttggtggtcttgcataatattctggaaaattccctggatttctaggcagagactcttgttgtcctcctttactttcccccaaacaaacggagcctgtctctgctgagccacctagagctgagggaggggtgactcaagcacctctgtgaccaccaccactgggactgcactgggtctgacctgaagccagcagaatactgggtcttacccaaggcccgtggtaaccactgtctgactaccatctatgttcactcaaggtcctagggtctacagtcagcaggtggcaaatccagcctgaagggctatcattgtttataccaccatgcctggcaatagtgaatgatactctgggagggaagtaattaatttgaccttaatgatatgtatatgattaggcagccttgttctttgttagccttcaacaatagggatctttttggtcactgtcacaggagtgaagacagaatgacttaccttgtaatgtttgttttctgatacattgggccaaaagacccacaggaatccacccgtcatctccagaaagtgaagtttttatttgaagtttgttctagtgtaacaactttcatcacatttcatgtttcaatagatgccaaagcaaagcactgagtgtgttggtatttctgttgcctgcttcagcagtgtctggctctcaaagttgtagccttgctacctaacctgagaccaaaatagccaagagcgttaaaactggtatgtgggttgggaaacaaacatagtgatcaggcaagccattttagaaggggtggtggaaaaaacttctccatacacttaagtcttcttaatattattttttacttttcaagcatctaaatttcccctaatgcacacaattaaatactgaaatatacattagaatttattcattagaaaatttgagatactctacactttaaattgaacttgtaccgtagaacttttaaatgattaggaatgtatgttttatagttaaaagagattacttagagtaattttttgtcttcactttcaatatgatgccccccccccctacctttttttttttttttttttgagatggagtcttactctattgcccaggctggagtacagtgtctcaatcttggctcartgcaacctctgcctccagggttcaggcgattctcctgcctcagcctcctgagtagctggaactacaggcatgcgccaccacgagctcattattgtatttttaatagagatggggtttcaccatgttgccctggctggtctcaaactcctcaagtaatctgcccaccttggcctcccaaactgctgggattacaggcgtgggacaccgcacccggccccaatatgatgccttttgatgacaaaaaaagccttaactttaatgaagttgaaggtatcagtccttcyttttatgggtgaatgcttttgtgccttaaataggaaattatttcaatccctgaggtcttaaacatattctcctatrattttttataaacattttaaagtttaattttcaaatttcagtcattaatcaatctactcagaatttatttatttacttatcttttgagacggagtttcactcttgttgcccaggctggagtgcaatggcgcgatctcggctcacagcaacctccgcctcccaggttcaagtgattctcctgcctcagcctcccaagtagctgggattactggcatgtgccaccacacctggctaattttgtatttttggtagagacggggtttctccatgttgataggctgctctcgaactcctgacctcagatgatctgcccgcctcggcctcccaaagtgctgggattacakgcgtgagccactgtgcctggcccagaatttatttttatacatgatatgagttaggaatctaatttcatatctttctatatggataatcaattgttttgtaccagttttcaaatcatccttttcccatcagtttatggaattatttatcatatattaagtttccacatttttatggggctgttctgaactcttatttttcactggtcagtgtttgtgtgcaagccagaatcacacaagcttatttgctatagcatyataataactttttacatctgtagggaaagttctcccctcctattctcctaatagaattcctaatttctatttagcttttgctcctctctctattttagagtcaacttactcagttaattgggggaaaaaaattgagatttgtattggaattgcattgaccctatagatcaatttggggaggagttgacatctttatgatacatatgtgaacatatgaatatgtccctccatgaaaccagtagatacagtcagtcctcacttgacattatcaatacgttcttggaaactgctggctgggtatggaggcttacatctgtaatcccaggacattgggaggctgaagtgagaggatcacttgagcccaggagttcaagaccagcctgggatggggagacctcatctctacaaaaaaattacctggatgtgatggcacccacccatggtcccaactactctggagactgtggcaggaagatctcttgagcccagaaggttgaggcacagtgagtcatgtttgcaccactgcactctagcccaggtgacagagcaataccctgtctcaaaaaaaaaaaaaaaaaaaaaggaaaaggaaataactgcaactttaagtgaaatgacatataatgaaaccaattttaccataggctaatggatataaacaaagttaaattcctatgtcatatttctggccacagaaaacatcatcaaacttctaaataaagacccaacacacttctaatattaaacattgaaaaaagtatgaactatgtgtttaagaaagattaataaaaacaaataagattattggatacacaatttttggtaaatcagggagtgacagaggtcatagtgatggtgggttaaatcaaggaataaatgtttccatagtgaaaattgtgagaagtacctcctactaccatgcagctcaaaaacgagtaatacgtgcggcagayttgtttatcacttttgtgttacatcmgtttattgtcatgcatttgtatgattatcacctgccttatgaatttttacttgacaatcatttgtattcactcattttccaacccacttattccattttggagtcatgggtagccagagcctatcctggcagtgcagggcaccaggcaggaaccagccctggacaggatgccatcccatcacagggcacactaacagatacccacctcagaccggggctattacaccaatgaacctaacttgtacatctttggcatgtgggaggaaactggaatacccagagaaaatccacacaggcatagggagaatgtgcaaacacagtggccaggctgggaattttttttcccttatcaattttgtaatgaaatgacattatttgaggacctgctgtatttttattttggttttaagtcctttcaataaattttaaaagtgttctctataaagggttttracatcttttattagattaattactaagtactttttgttagtatataggtcatatcttttttacaatagtcttctaattatttgttgctcttacagaaaaatgcaactgagtttgcatcttgatcttaaatctagccattttgctagagatcctctcattaatkataatactttgtatagagattccttttggttttccttgtggacagctatgtgatctgccaatgacagttttgttttgtcctttctcatcctaatgcctttttattgttatgtttttctatctgggacctccaggaaaatgtggatatcgtgtcttgattgacctaaggaaaggcttctaccatttcaccattaagcctgtgtttgctgcaggattttggtagctagccttgacctggttgaagaagttgtctaagggtcattttgttctctcactcactcaccacttagtrgtggatggtgtcgggaagaaacctgtttcccagytaaataaacatggtttaaatattagagctgtgaagtctaaatttttatatgatattttttctatatatacaaagaattgatttttgtatatcaattacctctgaaatcctgaagttcaaataaactaaaaacttcatcattccctattaaattcaggagaaatgaaatgctcaaagaacatatacatgattgtatagttttaaaagccagcagtttctgtgtagttcaatataaaaaatgttattccttttgaaaatattggaaagggaaagtgtcagacttacttactttgggtaatatatcttcttcatatatatatatatatatatatatatrtatatatatayacaatctaaattcgaagagagyaatatttctattcatgtaaatgccatacacattttactcatcaaggccttcaaataagtttcacatctgacttttacattaggcctaagccaaatgtattttcatttgttttagttcatttcttctgtttcagttaattagtttatagggcattgggacttcatgtggctgctttgggcatcttttatttttaagaatttatgatttataaaaattatagcatttatagtttcaaaggaatttcatatatattttcttaattgttttaaactttacaaaatgcacgtaaggctaggatttctgttatttttaaattttacagatgagaaaatgaaatgtatttagccaatggctaagccagaaatggaacctcagtcttctaactctaaatggtattataatatgctttaccactacaaatcttattaaattattttagtttaccaagttaatacttttaaagaatacactgtcaaattattgattcttattgtgtgaaaaagccaaattgaacaataagtataaatactcttatctttcaaggtattggaaggcataggtttctacaaaataaaaagtgtatattttttctttttttctcatatctttctaaactaccgatttaaaaacatttctatttctgcatttccattggtccctctcatgtgcttgttgaatttggtaatcccatttgagacagctcctttaacaatgctgtcacagttcagggagccttggcatgacacacgtaacccttctgtgcggtattctctctggcattrcattcttacattacattctctctggcattacattctttcactttccattttgtacttttctctattgctttatttgtatgtaatgttctgaagtccaaataacaaaatgtcatttggaagttatgtgaattattcctaaattacataaatgtgtttgtaaggagttattgaattgtttgtgatggtgatccatgaaataactaagaaaatttatttgattttttatgatttcagccaatgaaaaagtatataaaacagtataacagacacctatttacccatcacacaaatgtcgtagagattgacgttttgtaatatttaggagttttttaagtaaataaaaaattgcagatacagctaaggtcatacgtaattaactgctattcctttttctccatcttcatctcctaacctacatggtaaccattatcctgatgttatttattatccttatgcatggtttttattcttttgtttgacatacatatatatatatatatatatatataaactagtagcatataatcatgttttgtgtattttaaaaaaggtacattaatgtctcactgagcttatcttagtattctgcattgtaaataattgttttaacaattgtacaagtagatctatttattttcctcacattagacaattagattatctctatttttgtcagttatgaatacatacaaacaatawwwcagtgaacagttttatacatgcctttttgagcacttgtatgtttcttgggtagatgcttaaaagaggaattgctgggtcatctagaccaatatacacaatctttaactttgctaggcgtttccatattgctctccatatcttgacagcatactgtgttgaaaagactgtcctttgtctactgtgctgcagtgtcacctttgtcataaatcaaggaactgtatacatgtcaatctgtttctgtgctttccattccactggttagatatgtatgtcattgtgccaaatcacactactgtaattactgtagcattataatactgagtcatccagttcatgaacatggtatattccttcatttaattaggtcttctttaatttctttcaataatgttgtgtagttttctgtgtagagacttgctcattttgttagatttattcctaggtatttgatttcttttgatactatggtaaattgtatcattaacaatgttttattttgaattacaggttgggcattcctaatctgaaaatctaaaatctgaaatgctccaatgagcrtttcttttgagcatcatattgttgctcaaaaagctttggatttcagagcattttagattttatttgtaatgcaaatatttcaagattaaaaaaaaattgaaattggaaatacttctgtccccaagcgttttggataagtgatactcaacctgtatttgttgctaaaatataggggaaaagttgatttttgaatactgaagttgtatccaaaattcaatttttatagatttccttggattttctgggagcacaatcatgacatataggaataatgagttttattatttactttctagcccttataccttttatttttatttccctctcctgcccatttgtttcacaagtgaatgttgaattttatcaaatactttctctgtgttattggagataattgtatggtttctttattctgttaatgtggtgaattacattgattggcttttgattattaaaccaactttgtattcctcaaaagctctaaatggtttrtataaccttggattgacttattaatagtttattaagaagttttgcatgtatatttatgggtgaaattggtctgtaatttttcttgtaatgttcttttcaggtttgataagatatccaaatctgaaattatttgggaaaaattcttgttttgttctctggaagaatttttgtaatattcgtgctatttctttcttaaatgtttgcaagaattcagtagggatgttctctgcatttagagtttttcttgtggaagggcttttacaaatgtaataaatataggattgttagattttctatttcttgtgtcgttttgtgatttttaaaaaaggagatagacatattaaaaaagagattaaaaagagattaaagagattaaaaagagatataaaatatttgatcatgccaatatttgattgttttatgacaggcttattttttaatctctgtagaattcattttatttttatcattatttttatcattgttttatgacacgcttattttttactctctgtaaaattcattttatttttatcattagttttatcattctgcttataccaaactactttccaggttcttattgtgttaagctctttctgtcacaagaaacacaggtatactcaagttccttcaagtaatggagatatattaggtgcaatataaagccatatggagccttaagagaaaggaattacacaggaagagcaggatctctagcacagtttggcattagggagactggaaatgtgtggctaattagaatatgatacagctttagggatggaacaggttttctttttatcccccattagtaacatgttataaggctttactttgatacccagttgtttgtgtgaagtttctcacttccttttggcttttgtctatcttttcttcctttcattactaattaccctctttacccctggtctaaataatttttcatcataccttttattttctcataactacttacttatgatccccagtgccttgtggcctggttctgtgattctttttagcctctcttcaagttaccaagtaattgaacctcactggttctcagttaactcccaaaagattatttgattggcctagtttgagaagcttttatgctagctaggcccattggctggttctggctttttttttttttttttgagatggagtctcactctcacccatgctggaatgcagtggtgctgtcttggctcactgcaacctccacctgctggattcaagtgattctcatgtctcagcctcccgagaactggcatcatcacacccagctaatttttgtatagttggggttttgccatgttggccagcctggtcttgaactcctggcctcaagcgatccacctccttggcctcccaaagtgctgagattacaggtgtgagccaccgcgcctggccagcttggctactcttgaccagggagctattgccaaaatgtgggattcacatagcccagagcatggatgccctgggctaactcctctgccaagggctgtagttggacagtttcccttagcaggggtgtgtacctggaaaatactataattgatcagtacagataagtcctagaaaattaagttgttgcaagagttacaattctgcctcgttcacatgctgtggtgaatgctagtaaataattaaatgctggtaaaccaatgtctagaatttgatgttatatcttttagtagtcatctacctataactgaaaaattgctgccaaaaattacatgtgctgccaaccccaaatagggccatgggcaaatagatatgtaatacctgttgttttaagatggacaaatggaaattgatagtctttaaacataagcaatagggagaatatgcacataggcagattaaaaaatgcttaatgagaaagccatagcagttatccacttctggtcttatttcctttttaatacccaggaatagctgtgtgtactgctaagaattcacttttctgcagtatcacacagttcaggytgaagacagaggaccgctttccttttgtgatatttatgctacaaagtaatgttttgcctaatgcatttccacttatgagataaattgtggatattatcaaaaacttttctggtacaataagtgaaattcctttctaattttcaggaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggtaagtacgttaattcagcttgcatatattcttgaaaataagtcaagcccacattatcgcatgaattttccttttgtgtacatatttagatgctcttaaagcactcaacatttaggagcttaaataaattatttcaaggccgggcacggtggctcacacctgtgatcccagcactttgggagaccaaggcaggaggatcacttgagtctaggagtttgagagcagcctgggcaacatggcaaaaccccatcttgacaaaaaatgaaaaaattagccaggaacctgaggtgggaggatcacctgagcctggggaggttaaggcaacagtgagccgaggtcacaccattgcactccagcctgggcaacaaagtgagaccctgtctcaaagaaaaaamaaaaacaaaaacaaaaacagaaaaaaaacccacgttatttttattatgactgttaatactagaaaagacttaagagttaattttgtccaatagcttccaaattatttttaattattgagttattttattttatttattattattattatttgagatggagttttgctctcgtttcctaggccagagtgcaatggcactatctcagctcactgcaacctttgcctccccagttcaagctattctcctgcctcagcctcctgaatagctgggattacaggtgcctgccaccacgcccagctgatttttgtatttttagtagagacagggttttgccatgttggccaggctagtcttgaactcctgaccccaagtgagccgcccgccttggcctctccaagtgctgggattataggcgtgagccaccacacccagctgagttcttattttgaagaaaatcttttgtagaaaatcaatatttaagcagataaaaacagatctgctctgtcttctggggtagaaggcttggagacttggctgttaggctctgtagagcacagtctgaaaacttgtccatcctccccattttaggtgcagacctgaaacaaactgcaaaaggcattggaccaagatcattttgttgatatccctttttactctatgaacattacatgcaactgactaagtcttaccctcaatgtgtaaacctaaattttatgccgtgttaggaatatgagtgaaatatcctggcttcactaaggagaattcgtagtttaatctgtttaacaccttctgatttatcagttcttaaagcatcgtgtatatttcttacatgtacatttctaaaaagtaaatacagtctctgtgcatagtcaagctttgtgtatagagtgtcttgagttgttgtccagctacgtatttatataatatttgactgtggaatcacatcagaatatatcacatgctaatattgatattcttgagtagacactaaaatgctttaaagcttcatttttcatctgagaatgaacaaagtaccctgaattctgtttgatgccatgtcaccaaataggtgttattctgatccccatatatgtttaaattaactcaaaataagaaatttaaagagtctttctttagttcttaagacttaattgattttctattttataagaaaaacaaaccaggtattttattttggttacagtattaaggaaagtagcagagatatttagtaaagaaaaaaaaaagagaaaaaagaaaaaaattattggtcaatataaggggatttgcctggaaggaaatcttgttactgagccgaatagcaagaatgtttgtagatacaagtaaaataaaagaagggtttatttttgtcatataaggagaaggctggaggtgggtagctacttctggtgtttcagtggctctgccatttcactggcctttccctcagagttgtaagattgctgctgcagctccaggcatcacattcctattcacatgaggtaaaaaggagaagggactgccatagctcccccacaccctttttttaaaaaatttttttaggacatagtaggtttttaggatcctcccagaaaacttacctttcactgaccagaactgtgtctcatggccatagttgcaaggaaaacagaaaataagaaggtagtttttgtccagcttttaaatagagttaagcacagtaattgggartacaatcagtggtaatcagaaaatagtttctgtcacagggtgtggaatcagtaataatagtaacagccaacctytatgatatatttacaatattagtgtaatattcttatcaaggtacaggcactgttatgtgcaccttatatagagtactttatgtaagtacattcaatgagtacatgtctaagccttctaaaccatgctgatttcaagaaattggagtatttatccattcattttcatttattcattcatccaacatgtactaagtgaatacctaacatatggcaggcactgagaatacaaaggaaccacagtttttgatttcatgaaagctayrtagtggagaaaatcagcattaaccaaataatcacatacagaaatgtgaaactgcagctatgacaagtcaatgaaggctatatgcaagatgttaggacaggctgtgatcctgatatgatctggtcaggaaggtcaggggaaggcttcccttagcaagtaacttttgagtgcctatctgaaggatgagtgtaagaaggaaggaagtatatttcagagagagcatgtgcaaaagtcctttagcataaaaaacatagacaatgagtgaagggtggtcctccaggagagcaagattctaggtgaagcatagccatgtcattttaggagtttatcctaagagccatggtaaactattgaagaattttaaccagggtttggcatgattatgtctgcattggttacactgtaaagaatgtctggagaaaaaaccaagtagatcagaggaacccaaagagcaggctcttttggtggtcttggtgaaaggatcagtaagtagcttggattaagtttgtagtgctagtttaagtggaaaggagtcatatttgaaatatatttgggaaataaatcaccaggacttggcgatagataggggtatggcagctgagataaatggagttgtcagagatgacattgagtttgtgcatctgaatggtgaatggtgacatttactagaagaggatgttttttcatagattccgacgttatctttgtgtataataagtagaattattctgagacattcaaagggagctatcatatagtaggcagtggatataaagtttagatttcagacagagagatcaaaggtaaagatgtaaatttgttgtgagacatttttgtgtacgtgattgggtgtggatgagatcatcttgacagacagtatggtgragaagattaatgttctgagactgaaccttaaaactgccaagatttcatagttgagtaagaagttaaggttgaaaaccaacaaaggaggtgtagccagagaggcaggagagaaaaacagkacattacagtgtcatgggagcgaggggaaagagtgcttcaagaagaaaagtagtggtcaacagtgctgaaaggtcaggtgagttgaagcctgaaaagtcacctttggtcttagcaaaatagctgtcactaatgaccttagcaggagctgctttcgtggagtggtggggccacactgcagttaaaagagggctaaagagtgagttagaggtcaggaagtagagggggttagtacaggtgatactgcaaaggttggccaggaagaagacaggagagatccagtgagggacttgttttttgtttttaaatggtagacttgaacgtacttcaatgggatatccagtgggatatgttatttccaagaatttattattctaaaaataaataaatwaattaattaatcacctttggaggatcctagaatgaatcctaatgatacttaaaatcaaaatatcattagtcacwtggaggttgaaaactgaaaaataaagatccaagcaggtatcctatcttttcaaataggtaacggggaagtttctctttatagaaatgttccagccaataaaccaagcaggaatgacaagaattagagtatcaccctttttgcaacccctgatgtaataacagatttaagtaataatcagaaatggctgctaatgtcaccaaagcagagacaaccagacattaggtaaaagtttgtgacaacttatgatgtcttctggccaaaaaaaatcaaactgaatagtcgggcatggtggctcatgcttgtaatcccagcactttgggaggccaaggtgggtggatcacctgaggtcaggagttcaagaccagcctggccaacaatggccaacgtggtgaaacccgtctctactaaaaatataaaaaatagccaggtgtggtggcaagcacctgtaatcccagctacttcagaggctgaggcaggagaattgcttgaactggggaggtggaggttgtagtgagacaagatcacgccactgcactccagcctgggcaacagaggaagactccatctaaaaagaaaatcaaactgaaactgttcagacctctagatctagatrccaatttacaagagaaaaagagaatagaggaacatgttaaacaccaccrtaggggtactgtcagcaaaatctagactgtgggaaactataggacaaatgactggtgtttttttttttytaacaaataaatagcaatgacaaaaaaaaaaaaaaaaaaaaaggtgggggagagagggaagagaacctgcatattaaaagagagttaaagaccagtcacccagttccaacatacagatcttaattcaatcctgactcaaacacataaacctttttttttaaagcactagtgaaacatttaaaaatttttgagcactgacagggtatctaatgatactgaagaattacttaaaaaaaygtttaagtgagataaacagtgcaatgcaatggttatgatttaatagaaaaatccttactttagtgatacatgctaaaatgtttacatattaaatgatttgctacccaagatatacatcacaataatcaaggatggatagggaaatttggtaggatagagatgaaatgagattggccatgaattgatcattgtttgagcttgataatggctacattggagttgcattatgcatttttctttattgtacatctttggatttttttataagtttttttgttattgttctgggatttagccatttgagaaagagataagatccctcgtgtaggataggcattgtttcaaactgtgcgtatgaaatcagtgcattgaattgcaattagcattttggggtartacttcctagatagtgctttgtgttccacatcatggcatatcagggtgcaaccaatgtccagttgacccaaataagctttttttttttaatgcagtagaatggagtagaagaaaaagtatcaaaatcattaatttatagcatgtggcacagaggtggagttatgcaataagaaggccattacatttctgtgtcatcagtaatgacatagaaattataatgttattaggagatgttaacattggcccaataatgagatttaaactctgttgtgctaaaaacatatgtatatataggacaagtcacccagttccccatatatgtgtgtgtgtgtatatatatgtatatatatgtgtgtatatatatgtgtatatatgtatatatgtgtatatatgtgtgtatatatgtatatatgtgtgtgtatatatatgtatatgtgtgtgtgtgtgtgtgtgtgtrtatatatatatataattttttttttttttgagacggagtttcgctcctgtcgcccaagctggagtgcaatgacacgatcccaggatcccagctcactgcaacctccgcctcctggattcaagctattttcctgcctcagcctcctgagtagctgggattacaggtgcccaccaccacacccagctaatttttgtatttttagtagagagggggtttcgccatgttggccaggctggtttcaaactcctgacctcaggtgatccgcccgccttgacctcccaaagcactgggattacaggtgtgagccactgcgcccggccaaaaacatatttttattaaaaccttagtgcactgtagttttatgctagacgttagggatacaaacctgaataagataatttacctgtctttaaggccatagggcctgtgtccctgcatattcttactgagtatgccaagaaagcccctgtctttaaggagctcaagtgcagtaagggagatggagaagcaaatctttacaattcggtaagaccatgcaatgctagagaagtgtatgtgtatacgtgtttatttgcttgctcattccttcattcatgtttttcctgtcatcttccagaaaggaatgagacagcttgcagaaaattcaaaatagcttaagtgaataaataaggatgagggcttaaaatggagccatgactgaggcttaaaacatcaatgcccaatactgctgtggataagccataaatctggttcaaaggtttccacaaagctaaatttgttcagttaaatagttcacagtgcccaraaagccaaatgaattaattagttaagarggcaacttaaaacaaatttttattgtgtttgacagcaatcttttagtaataaaatcagctagaagaatatattgggtagtatcacacagactaggttttattgggtcccattggttacagtttaggaaacaaatgtttgmttatattattcttggatcacaggctccactgagacagaaattgtgcttgttctgcacaccttttatcccctattcctagtactaagtagatgtgcagtaaatatttgtttaaaaactgacaataaaaactgtaatataaataagatgtgttgacataactctgtttcttagtccaaatttctggaatctgaaggaaacatccccttgtgattcaaacaccatctaaaatagtatattggagcttaactaagttttgccacaggactcaaaaagtcatcaaatttctatgtaagtttcggtcttataaagaaaacacttaagtttaggtatgtggcaggataaattattaatacacaggaaagagcaaaagttccagtgtcatggagattagtctgtcctgacaacactctgtgtaccagtgcacctttgtgatgctgagtaagaggagatttgcacttcacgaaggtccaggttaagcttagttgctcagtctggactctggtccctaaagtgggaagtctcaggcaaatctgagtatcagaccatgccggcaattcagctctcttcacctgcttctytctctgcaagatgggataatcatgatacttatatttcagggtgttgtcatgtagtttaaataatgcatataaaacaatctagtacctgacatatagtagttccttggtaatattagttacaattttaagtcccatctctatgacactttgaccatttcattccacaatgatctgttcacggtaaactcctaatgccctatttatttggactcagttatttcagtgtcttatttcagtatctatcttagttcataactggttatcctatgccatcatgctatttgttcactatttgagggaaagaactctactccattgtrtattccctgccccaytcaggatggcagtaagtacagctactaatataaattaaagtcattcagaaatgaaattattttcacatttatattacattgttttcacttcatcctggaagttatcattagtctgaaacaaacccagagatactgatcccatatttcaaaattgaccacaactttaaagcattaattaattaataaagaattacacgtgccagtttaaaaagaaatatgcagattatagagatttaaatactgaaatatgggacattttcctgtgctctgccatttgagtagctgttagtttatcaaccttcaggtcatgtttatagaagcactctgccacagggcctgtgtccctgcatrttcttactgagtatgccaagaaagcccctgattgctttttacatgggccacttatttgtcaaagttgtgcttgcagcaaacaacctggagggataagttaattctccccttaaagaggaagcttgcttcccttgttgtatgcacagcatccatggtacatcaccctcacaggacttgggggctaatgtaaaccaacatgagtaataaagtcctttgtctctgacccagtggccttgtgtcttctgccgttatctgtgaaaccagtggtattagggtaacctgttagcttttaagcagagtaaaatcctagacttcacacagtttttgataggtcaataggattctcagatctcttgctaatattaattacctgcaaaatgtgagtaaaccggctgygtatgggaaagaataggggctttagatctagaaaactcaagattctgtacaagttctccagcatcctggccatgtgcaagttacttcatccttctagarccctgagagaagtactgtgccatagtcaagagaatcagacatgttatacttgagcacaaatcttgcttttcccttttaacaactatgtgacctttttcaaattactacttctcagtgtctcagttcttttcctgtaaaatggagttgatactgctaaccctcatatattattgtgggaattaaataaagtacatgaaaatgccagacacattgtaggtacctagtaaattttagttttttttcttccagattctatgccattagtattttagatttaaaagtctgtcttcatatatgtgtgagtatagtgctcacttttctaaacttagcatcggtttttgcacctataaaacaaaaagttcgataataccgacttcacaaggttgatttgagaataagttttgaaaggatgtgaaatcactatgaagtgcttctcttagttgttctcattgaaagaagttgaccaaatctaatctccctgacactttccctcttggagcactgtggccataatagaattgagaatccaggaacctagaggcaccacccacacagaatgggataatggcagtgcctttccttctgttcctcaggaagtggctggcatggaaggtggtctcatggaagatgcacatcctcctccatgctgagacatgcctttatctcatgactcaggaacagccttaaggaactggcccaattgccaatcactgtgtgaaagaacaaccaccaaatttgttgtttcagcatagtaggattcattctcaatttattccrtcaaacatactagttttttagctacttcgggatatattttgcagtgacttggtcctggtgggtagtgttatgtggaaagatacgcttgttacaatatgtgaaaaagagccagttacaaagcctggcattcatttcacttttgtatgagtaattgtatgtataaatatatgyggagaaaaccrtctagatagaaggcttattccaaaataccatgggggatatggctttatggtcatttttcttttacttatgtaaatttttaaatttctaaaataaatgtgtgaaaaaagtaaaacctcctcaccctcacaaactaccagtattggtcaaaatgagatgttttataggaatctggtgaaatgcttacatggtcactgtctgacaactctttttttctggggcaaatatctctttcctactcagggacrtggaatttggggttttaagctttagaccatcctgggcacttcaatatatcagaccttacttgtccacaaagtttttcccagactataagtaaccctagttcttcttcctttaggagttgatggcattctgtctgggagagaatacaagattcatgtatttaattttcataataaaaacactgctcatatggcactcttaatcttcagtgcacattaaattttttttttccatggagctttaaaaaaaatactgatgcctgaaccctacctccagaaatctttttttgttttgttttgttttgttttgtttttattgatcattcttgggtgtttctygcagagggggatttggcagggtcataggacaatagtggagggaaggtcagcagataaacaagtgaacaaaggtctctggttttcctaggcagaggaccctgcggccttcsgcagtgtttgtgtccctgggtacttgagattagggagtggtaatgactcttaaygagcatgctgccttcaagcatctgtttaacaaagcacatcttgcaccgcccttaatccatttaaccctgagtggacacagcacatgtttcagagagcacagggttgggggcaaggtcatagatcaacagcatcccaaggcagaagaatctttcttagtacagagcaaaatggagtctcctatgtctacttctttctacacagacacagcaacaatctgatttctctgtcttttccccacatttcccccttttctattccacaaaaccgccatcgtcatcatggcccattctcaatgagctgttgggtacacctcccagacggggtggcggccgggcagaggggctcctcacttcccagaggggcggccgggcagaggcgcccctcacctcccggacggggtggcggctgggcggaggcgccccccacctccctcccggacggggcggctggccgggtgggggctgccccccacctccctccaggacgggggctgccccccacctccctcccagacggggcggctggccgggcgggggctgccccccacctccctcccagaaatcttaagttggactggggcatggtctggaagtcacattttaaaagtgtcccagatgatttcaaagtgaagccaagaygtggaagcacttcctcaagccctcgctggagaaatcatgtgttgaattataaaaataataggtgcttattatgaaatgtaacaggtgtactagggtatgaagtgaaacaaaaacaccccattctccccaggtctaccatgtttctttaggtaacatttcacaagtctasaagtatacatcttttcttttctaaaatggtatcatactaagcattactattgtataacttgcttttgtttcctaatatgtgggagacatatttctctatcagtttatacagattagtcgtgctctttttaatgactgcagtgtatctggagtacagatactccttgatttctttaacctctgagagctccgtctgggacagactgccctttagtatatgggacatgttccctatccattccactgtgctcccacatcttcctgttgttaccactggaaaggaatctacatggactacattaaattttatccctaggatataattatatcccattaaattatatccctaggatatagtttaatattacgcccttgtagctttcattgattttttatgaaataawtcagacgtataataatcctccatgcaccttctaccctactaaagaaataaaacactacaatacaatcgaacctctaatcctccctaatcccattgccctctaccctatccatagtaactaactggttgtccttgactttggtatccatcccatgcatttctctacatttttactcactgatgttttttgaaacaatgcatggaagtatttggtatgcttttaaactttacacacagtgtatcacactatattcttctgtaagtggctttttcccccctcagtgttatatatttataaaattcatatgggtacatatactttgagttcattaatttttccctaattatgatagtttattttatgaatatattactattccctcatttttcttgatatgatgccaattttttgcaaatataaacagtcatatttgtgacttgtctcatactcaactcctagtgcacacaagggagtttttctcaatctaggagtggagttgttggattgtaaggaacatgtgtctttcatgatctccaaggaggctgtaccagcttagaatcccaccaccagtgtttaaaagtttgttctcatgcttaaaatagattagaataagaaatgttcatttgatgatatttctatatattctccaaaattgctcataagaacattttcatttttattacttaatgtccttcacatgaagtgccatctgttaaattatttttttgttaatgctagggacattttttctctccatgtgcatactgtgcctgtttacaaaaagatttgaagcaatttattggccttttctgacaaactgccaggcttcctgctatcagccagtggctgcttcctctttaattcctttttgtcttggctgccaagacagcaagagctaaactcaaggctcaggtgtggaaacaaatttggcttagttttccccttcgcttcttttatgggagtatttctctagtgtcattcttagaacagctgcatcagaatcttggcggtgctagttaaaaatgctacttactaagccctttcacacatctttttaattggaatctccaaggtggtacacaagaattagcattttaaaagctcatgctaagcttaaatgtaagaatctactgtatggcttgtaatcttagtttcatgtaattgtttcattagaatatgttattgtaartcacttcaaatgctttttgtactcaatggaaaaaatattaaaatctagcagaatgagatatttgcataagatttagctccaagctgtatctgtaaatagattctattatcaattggccatttagaacactaggtttaaatctgtggattccataaatattcattgagtgcccactatgtgctatacagtgtgcaagaagaagaagtaaatggatgaaacgctataaacagacaggaggttaggaatttttttttttttttttttgagatggagttttactcttgttgcccaggctggagtgcagtggcataatcttggctcactgcaacctctacctcctgggttcaagcgattctcctgcctcagcctcccragtagttgggattacaggcatgtgccaccacgcccagctaatttttgtatttttagtagagacggagtttcaccacrttggtcaagctggtctcgaactcctaacctcaggtaatccacctgcctcggcctccagaagtgctaggattacaggtgtgagccaccgsgcccgcctccagaatcttttatctgaatactataacctcacaygaatcttttcctgaataagaagcagatttttttaaaaagtagagttttggcaaacacatacatttgtttctaatggatatatctgtgcattatgatatgtgtactcatcgatgaaatatttctagacccatatttccaaggatcattaacatccttgaatgcatcactgagataagatctgtttattatcttgatgaatataaacttaaatctcatctagccttttagactcagtaattaagttttagaaaagcaatgaattattaagtctcattagaaaacagtttgaaaaaagcaaaacaattggcctcttctctcagcataatttatttctattaaacgttggtgattaagcgttgatgaaaagagatatttactcgatgtggcccatagctaacaattttcatgccatgctacttacacaaactccctcttctgacacccagcttcagggaattctgtgtactcagagtggcacgagtgtgtttttcttgaaagagaattggaagataatagacattcaagtacttagtaacttatttgtttgcccaacttagtgtaattcagaaaatattgagcactgactgtggagtatttgtactctatayaaaatatattctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttcatctttttcatgggaaattattttatgaatttaaggcttgttcctttaattagcttcctcaaagtcacctgaaggtttggtttgatttggttttaaatgcaaatcccaggcaaatcttctgattgaagatcccctggagatagatactgttgtagtaggtatgatgaaggaggcctttagacactatttttttaaaaaagactttaatttttcagagcagttttaggcttacaccaaaactgagaggaaggtatagagagtgtccatctacacttaccactgcccctgcacagcctcccccattttcagcatcccccaccagagtactccctttcttacaattgatgaacctacattggcacatcattaccacccaaagtccatagtttacatgagggctcattgggtaattgataaacaaagtaaatttattacagttctgtagactgggaagtccgaggtcaaggggctacatctggtatgggccttcttactgcctcataaaatggcagaaggcatcacatggcaagggggcttactagagaaaaccaaactggcttttacaacagacccactctagtgaaagtaacccactcctatgataacccattgattcattaccccttaatccattaatccccaaatggattaatccattcataagggcagagccctgatgacccagtcacctcttaaaggccccacttaatactgttacattgggaattcaatttcaatgtgagttttagaggggacaaacattcaaaccacagcattctgcccctggcccccacaaattctatgtccttctcatatacaaatacattcattccatgtttatagccccaaagtctagagtctcatcgaatcagatgtgagtaatgctcaaaggacaattcatcttgaggtaaatttcttacagctgtgagcctgtgaaatgaacgtgttacctacttccaaaataaatggtgggacaggtgtaagacattctcatttcataagggagagataggcaagaagaaaggggtaacaggtcccaaataagtccaacacccaaaggaaaaactaagccttgaggctccagagtaatcttccttggttccatgtcttgcttcctagatacaccagtgtgaggattggatcccagggcctcaggcagccccaccacctaggctttcctgggctctcccaggcttcagttctcacaagtaacagtcaagtgcctgcagctttcccaggctggagctgaatgctggcagttctacagttctgagatctcagcraggttctgttctctctgctccactagacattaccccacttggggttgtctgtcctggctctggctctgaccccacatttttgcttggcattaatccacgaatggattaattcatttatgagggcagagccctcatcacccaatcacctcttaaatgccccacctcttagtactgttacattggagattaagtttcaacttgaatttcagaagggtcaaaatttgaaccaaagtactgtttatttccttttcctgtcttattgcattaactagtacttccactgcagtgttgaaaaggagtggtaagaggtgacagcttcctattttggctgatcctagttggaaaagcttcaagtttctcaccattaagtatgatgttagctataggtttttttgtgaatattccttatcaagttgaggaagttctcctctattcttaatttactgagagtttttatcatgaatgggtgtcggattttatcaaatgctttctatgcgtctgttgatatgatcatgtgatttttcttctttagccagttgatgtgatggattatgttaactggtgatcaaatgttcacccagtcttgcacacttaggatgagtcctacttagttatggtctgtttttctttttatacattgttggattcattttgctaatattttattgaggatttttgcatctatgttcatgagagatattggcctgtagttttcttataatgcctttgtccggttttggtattaaggtaatgctggccttatagaatgtgtcaggaagtattccctctgcttctattgtctgaaacagattatagagaattggtctaatttcttccttaaatgtttgatagaattcaccagtgaagccatttgtgcctggtgttttctattttagaaggttaatacttattgattcaatttctttaatagatacaggcctattcagattgtccctgtctttttgtgggagttttgacagattgtatctttcaaggaatcagtctgttttatctaggatatgaaatttatggccataacactttacagtattcctttattatctttttaatgcccatgagatctgtggtgatgtctcctcttctatttttaatattagtaatttgtatcctctctctttttttcttagccaagctagaaattattaattttcttgatcttttcaaagaattagcttttggtgttgttgatttttctctattrattttctatttccaatttcactgatttctgctgtaatctcatcatttattgtcttctgcctacttcagatttaatttactttcctgtttctggtttgcccttgaactcttatttttaagaatctctacargtgactctgatgcacaaatttaggagccattgtttgcattttaatttctaacattttataggaagaaaaacaggatcagagagagattttgttttgcatgaggttataatgtgtgcagtttataaggatgcagcctctggttatattgggttcccctgtattcatcttattgatttatctgattaattttatccatgatgacagattaatcttcctttgacaaccttaattatgtgtagttttcctagctatagttaacattgagtgaaatcatttgctctgttaattatttttctttgcagttcttgggactttcccacaaagtggactactagctatgttagaggatgagttgcccagtcagcacagtgtggattttctttgaaggaaaatacctgtgtccttcgtaagtgtcctacacatgctttatagacagggcyagggaacactgtcatgtgagcctgtagaaatttagaatttttctggattgttctcttgattctcatcagtgtttccacggaaattgaaagattgctacagtgggttttgcttgattatatgtgcagtttagtattataacttttataaataaactttaaatactgtagtgtgatcttattgcaatcattagaaggaaggattatatgagagaaacttwtttttctattataatacacatgcttctcaagttaaaatgggactatgccctgataaacccatcataagtcagaaacatcataaatcaaaaatgcacttaatactccagtaagctcgttataaaattttaaaataataagtcagggattgtctgtaattttacttatgctaataaatgtttttcatattgctagaagaaggctagttatttctgccttgtcttaacagaatgatacgatataattcttaaatgtatcatttgtgatttttaaaamtaacatttgtttttctaattacacaagtaatgcatgttcattatgcaaaattttaaactcaaaattttttaatcacttgtaattccaccacctggagatcattgttgtttaggtagatggctttccaggcttttttaaagtgcacatatgtagtggtaaatcatttgtaatttcattccatttctgagttattgtttatgtttaattaaatacaagacagatttactaattcacgctttttatgccttttaaataccatatggtgcctacatatcttttagtaattggtattctcttacagtctttcctctacttggactttagttttttggggtgtttttcttccttataccatccttcttaaaagttagagtactttgttagttaggagattagctatcttttgtaaaatgtatgtaatatccaaaaaaaaaaaaaacaagctttgacttagacatccattttggacagagttcaaagtttttagcaacctgaagtgaatgggaacatcttcagtttcagaaagcacacaaaataaactaactcttaaaacctctccaggttgggcgtggtggctgamtcctgtaatcccagcactttgggaggccgaggcgggtggatcacgaggtcaggagatcgagaccatcctggctaacacggtgaaaccctgtctctactaaaaatacaaaaaaattagccgggtgtggtggcggggcgcctatagtcccagctacycgggaggctgaggcaggagaatggcgtgaacccgggaggcggagcttgcagtgagctgagatcgcgccactgcactccagcctgggcgacaaggcgagactccttctcaaaaaacaaaaaaacaaaaaaacaaaaaaaactctcccatacaaagcacttagaggataaatctatattccacttatatgagatgcctagaataagcacattcatagagacagaaaatatggggaaaggggagagttttccaggatggggaaaggggagagtaaagagttactcttaatggatacagagtttctctttctgtttctgatgaaaaagttctgcaaatggaggcctggcatggtggctcacgccataatcccagcactttaggaggctgaggtgggcagataacctgaggtcaggagttaaagaccaggctggccaacatggtgaaactctgtctctagtaaaaatacaaaacttatacagggtggtggtgcaagcctgcaatcctagctactcaggaggctgtggcaggagaatctcttgaacctgggaggcagaggttgtggtaagctgagattgtcccactgcactccagcctcggtgacagagtaagactccattaaaaaaaaaaaaaaattctgtaaatggaaagtagtgatggctacacaacattgtggatgttaataccactgagctgtgtacctaagaaatgctaaaatggtaaattttattatttttatatatatatatcataatttttaaaagcacttgaagtatgtccaataatactrttgtaataggaataatcattgcctctacttaacaattttaatatttaagctctagttatcattcaatatgaaaagtcctcttttcctaattgcagtatttctccsttatactagcattttccttgcaaaaggcccagagattgtgatttgaagggacagaagcccactccatttgcctgagagacatctagaatattatctcaaaatagtaagatctcataaaaacaaactgtttttcaaatttccatgaaagtgttttttaytttagaaactgacccaaaaaagtactaatttcttttttccacaatgctttattaagctttgttgacctatataagggttataggcgaggaggggagtagggggattagaaagattagtcagctgccactcctaaaaatatcagagtgattttttttttccttaatcacataactgtaaccttctgtctactcagggcaaactaactttaagatgaaacctaaagaatggatttttcattttttactacatttgactgtaaatacagacagcttgataataataacatatgctgtggaattccctaaatctctaacatattttaacatcattgtctagtatagtatgtcttataaatgattgttgatttaataaaaactataaactttatttatttttttgtttttttgttttgagatggagtctcgctctgtcgccaggctggagtgcagtggcaccatctcggctcactgcaacctccacctcccgggttcaagtgagtctcctgcctcagcctcctgagtagctgggactacaggagcgtgccaccacacccagctaatttttgtatttttagtagagatggggtttcaccatgttggccaggatggtctcgatcacttgacctcrtgatccgcccacgtcagcctcccaaagtgctgggattacaggcgtgagccacctcgcacagccaaactttcttgttaatgtatatcttgtcttgcttctaaaactgatttttaggcgtgagccactgcgcccagccatcttaggcactttactgagatatttacaacatagcagaataataagagaagagaatggtatccaaagactctggatcagagagaaaataagaattgaattatgatataaagccaggtataagatgttattcagttgttttctagtaatcaagctagaataaataaactatacatttcttaaaggaaattaacaggaratacgtttatcaataaacagttcccacaattataaatgcatacttccccagtagccttgatgactggttcatgagccagtatttcttcagtgtgtattcagcattgctacttccattggtactrcatccrtaccatcaggtgctatggaaaaatagaattgtaatagaaaatgtgttggctcctaatgcagtggccttcaaactaccctccagggtgtgagtcccacagagccgcctcagaataacaggcctaatagtcctgggttcttaaccagagcaaacatcattcattgtatctaatctgcagagtgaattttcttataaaatattaaatattttatattaaaatatattttaaatatttaaaaagttctacaaatggaaagcagtgatggctacacaaccttgtggatgttaataccactgaactgtgtacctaagaaatgctaaaatggtaaattttatgttatatatatttatcataatttttaaaagcacttgaagtaagtcaaagaatcctmctgtaatagaaataatcattgcctctacttaacaattttartatttaaactctagttattacattttaaatataattaaaatatatttttagtttaaatacttaataaaaatacttaaaatatatataaatataaaataataatacttaaaaataataaagtaaaaatattatttgaacaaaggatttaacagctaaaaagatattttgaaacctctgacctagtactagagtcaagaccattgcctaataaaagtatgtccaagatctcctgaacaytggcctgccctccttaagaaagaaaccctataataccatgaggcatgtaggggtgactcaaaaaactccaggccagaaacyagaacacctaataagtatttgtctcttgtctgccacagattagccctgtcaccttgaggaagtggcttgacctctgaaatgtcttatctcatctataaaataggagtataaaatgattactaagaacttgtccagcaccaagactttttcaaaattctttctcttgcctcaaagatggcaaagaatgtgccatcagacaagctcttcccttctgtcaaaagagaagaaccattggagaaagaaatgaccaaattctatgtagagagcttgagcaagaagaaaaaatgtaggggaagggtaaatagctctgtctagagcaattggcttttgttgtttacagcttgtctatgtcagaccatcccgtaggaaaagtttggtaagaacaaagacctttgataaaagatgactgagagactgtctggggtttgatgcaaagatcatcagaggcatctacaaatgagtagtcaccagtgacaaaatctcaaagcgaggcaggctggagaatgggcgatctgttagtcttgccagagaggarggtattagcaaaggcagattgaataagcggaaggtaaaaaaataaaaagcagcaatagcattttttttttacatatacttcattagcacaggtttggctttaccaatataggaaaggcatttttacactaattaggtcattgtgaaaaagaaaaattggagttattttttaaatgcagtgtttttaactaagaagaaaatatgagaccgggtatggtggctcatgcctgtaatcctagcactttgggagcctgaggtgggtggatgacttgaggtcaggagttcragaccagcctagccaacagggtgaaaccctgtctctactaaaaatacaaaaactagctgggcatggtggcacattcctatagtcccagctactcgkgaggctgaggcacgagaattacttgaaccctggaggtagaggttacagtgagctgagattgcaccaccgtactccagcctgggcaacagagagactgtctcaaaaaaaaaagaaagaaaatattaatactgtggaggttatgtgacagtctttaataacaacaaccagttatattactataataagctttccatgaaaacaccaaaaagtactttttgatatcttattaaaaattaagattctgtcatatttcttagaattatatacattataattttatgttttttagaataaactcagcaatactgtacaaggatatcgtaatctatatggaagcacaaaggaacatataaatttaaatccttttgctccatgatcagtcacttcttttcattttaaactttrattttggacattcacaaaattgttaactcttgagtgatgtggattgagtaagttgtattacaattgtaaaaacaaatgattcatttcaacttgtattgaacatcttatgtgcaagacactctgcttaacacttgaggggactacagagataaatcagtgaggtcagttctatgggaggggaatcagggacagctacacagaagcagcttaaggatgataaggcttccagtccacagaaagagaggggtgaagatgattccagtataatggaaccatgagaacacacagaggaataaaggtgtgtcacatcasctctttgaatatgccamaaaaaaaaaaaaaaaaaaaargctctgaattagttttccctcagtatctgctggggactggtttcaggaccccccagtatgaaaatctgcagatgatcacatccctgatataaagtgggatatttgcatataacctgtgcacatcctcctcgatactttaaatcatctccaggttacttagaatacctagtgtaatgtaaatgctatgtaaagagttcctatactgtattatttttaacatttatattattttgtattgttttttatttttattgaatattttcgatccacagttgattgaatctgcggttgcagatacggagagctgattgtataccctctaaaaggatgaattttatgctatgtcacttatatcttaataaagctattatttttcaaaagtacatgccgtgtgttagrgatggcaaggataaattgttgtcatggtgacatgggatcctgtgttgtgcagaaggagaggagactggagagaggtgtaggatcagaccacacagagggtcttgaaaaccatgctaggaattttgaattttattttccaggcattagtaaaacattgtaagtttttaagcataggaatcaaaatgactccattgattttaaaatacggagctaaaagataaattagctgttagtaaaagtgaaggtggagaggaaaaactaggctattggaacagcttcgaccaaagagtgtaaattagtgaaactagtttgcaagaatactagrgacaggggtcaggcacggtggctcacgcctatyatctcagcactttgggaggctgaggcaggaggatcacttgagctcacaagttcgagaccagcctaggcaatgtggcaaaaccccatctctaccaaaaatacaaaaattagccaggcatggtggtgcacgcctgtggtcccagctactcaggaggctgaggtgggagttcgcttgaacctgggaggttgaggctgcagtgagccaagatcgtaccattgtactccagcctgcgtaacagagccagaccttgtctaaaaaaataaaataaaaatgctggggactggatattgcatcttaaaggggcaaggaaaatgaaagaaaatgctgaattctcattttcatatttatagaacaaagatactgtattatttttctgaactgtgtaaccaactatcacaaatttagcagcttgagcaacacacatttattatatcaacatttctgtggttcatgaccccagacacagcttagctagggttgtgtgaggctgtggttaaggtattggccagggtgggattctcaccttgagtcaggactagagatgcatccactttcagaattacccaggttgctggcagaattcatttccttgaggttgtgagtctgaggtcctcagcttcttgccagctgtaggctggggactgctctcagctcctagaggatgcttgcagatcacatggccctctcaacatgacagtgaacttcttcaaagccagctggggagaaagtctctagcactagttgactggcaaaacatacaacatcatataatcgtgaaattaatatctcatcacctttgccatagtctgatggttcaaagcaagttacaggtcccactcacaataagaggaggaaattatccaagggggtgaacaccagaaagtggagatggttggggtcactatagagcatgtccaccacaggtacttttcagcctcttaaagtacagtagagtgtcctctaaagccgagtgagcagagtgtagactctggcgtcagaccgagccaggtttgaatcctgactccatgactgactatccttttgagcactaaacctcagtctcctcatttgtacatagggataaagatctacgtctcatgatgtggtgtcaggacaaaatgagataatgccggtaaaacacttcagtgagtgcccaagacaggaaaattgctcacatatgttatcacatttgagtctcagctaccatgagaagtaattgaaaagttttccattaaatgatttacctatattaaatcagtttttgctcttgagtaaacttaatctaatggactttttgctatatcattgtgagcatggattaatacattcatgaaaaatcactagacttgagtagaggattttttttttaatcaacctcttctttttacagacaaggaagctacaaccacatagaaaagttatccgacttgcctaagatctcacagtacttagtggctaagccaggactagagtgatggcctatttatgcaagttactgctgtttctaccatgtttagctgtgtgacataaatttttaattacgacatttatacattttttcactcaatcttgtagactagaagctcctttttcaatgagacagctaattttttaatgccaagaaatagatacatagaaaagttcaaggccttagccctaaaataagaatttgcaaacttctagtgacagtactcaatctctctgaatgtctctattgtttaagacgtgatctgatgttttaactttaaattaaactaaattggctgggtgcggtggctcaaacttgtaatcccaacactttgagaggctgaggcaggcggatcacttgaggcraggagtttgagaccagcatggccaacataccgaaaccmcatctctactaaaaatacaaaatattagccaggtgtggtggcgtgcacctatagtcccagctgcttgggaggctgaggcgtgagaatcacttgaaccctggaggtgaaggttacagtgagctgaaattgtgccactgcaatccaacctggacaacagagtgagactctgtctcaataaaataaaataaatttgctacttatatgtgtatgtgtcttcacactgtatatctgggcacgctctatattttttgaaccgattcttaagggtatcccaatgatagtaatgaaaataagcagcatgaaattttatagccatcctagaacaatatttcctgtgtattttaatccactggaattgggaaagaaggattgattatgttgttttcatttaatgtccatttatcaatctccatctttgtgtcagatgtttgctaggtgcttgggggatgagaaagggtcaccacatgaccataatcctcctacccagagataactactctaaacatgttgatagccttctatatatattttttgcacatgtagtttttaatataaaaagtgacacaataaaatactttcaaaaattataattacagaagcagtggctgtcatggtaggaggaaactaaagcaaatcagagggcacaaaactgaaaactaggaggattcccatttcctcccaaccccctgctaccctccccagccctactcactagaggcaaccactgagtggtccctgattttcttctggtagttaacattatattcatataaaatattttaactctggttttagatttattagctttagacagtatctgttaaccttttgctataaaatatgaagaaattttttatcaattcaagcttgagccgttcttcttctcagcttccagtttctaaaactgtttttaccttgaaaaggtctctgacatttattattactggtgtattatctcttgtgctttttcataggctagtttaaaaatggaatgcattattgtgatcacatgttacatgtgtattctctttagagctaaatatatatgtatatcattctaaggtactaaactttgttgtttgacaaacctgacaaaacaagcaatggggaaaggaaaggggaatcttctaggcatcccagtctaaaactcttcatttctatccagcttttttcacttcttccatttcgactgctactcttccttgtatctcatgttattatcttccttgaatattcttttttttttctttgctctgttgcccaggctggagggcagtggcatmatctcagctcactgcaaactccgcctcccaggttcaagcaattctcgtgcctcaacctcccgagtagctgggattataggcacttgccaccacacccggctaatttttgggtttttgttgttgttgtttttattatactttaagttctagggtacatgtgcacaacgtacaggtttgttacataggtatacatatgccatgttggtttgctgcacccatcaactcgtcatttacgttaggtatttcacctaatactatccctcccccagccccctacccctaacaggccccggtgtgtgatgttccccgccctgtgccaatgtgttctcattgttcaacacccacctatgagtgagaacatgcagtatttggctgcatagtattccatggtgtatgtgtgccacatttttttttaaattttaagaaatgctctttttttttaatatactttaagttctagggtacatgtgcacaacgtgcaggtttgttacatatgtatacatgtgccatgttggtgtgctgcacccattatcttgtcatttacattaggtatatatcctaatgctatccctccccactccccccaccccacgacagaccccggtgtgtgatgttccccttcctgtgtccaagtgttctcattgttcagttcccacctatgagtgagaacatgcagtgtttgattttctgtccttgcaatagtttgtgagaatgatggtttccagcttcatccatgtycctacaaagtacatgaactcatccttttttatggctgcatagtattccatggtgtatatgtgccatattttcttaatscagtctatcattgatggacatttgggttggttccaagcctttgctattgtgaatagtgccacaatgaacgtacgtgtgcatgtgtctttatagcagcatgatttataatcctttgggtatatacccagtaatgggatggctgggtcaaatggtatctctagttctaratccttgaggaatcgccacactgtcttccacaatggttgaactagtttacastcccaccaacagtgtaaaagcgtttctgtttcttcacatcctctccagcatctgttgtttcctgtcttyttaatgatcattgttctaactggaatgagatggtatgtcattgtggttttgatttgcatttctctggtgaccagtgatgatgagcattttttcatatgtctgttggctgcatgaatgttttcttttgagaagtgtctgttcatatcctttgcccactttttgatggggttgtttgtttttttcttgtaaatttgtttaagttctttgtagattctggatattagccctttgtcagatgggtagattgcaaaaattttctcccattctgtaggttgcctgttcactctgatgacagtttcttttgctatgcagaaactttttagtttaattagatcccatttgtcaattttggcttttgttgccattgcttttggtgttttagtcatgaagtccttgcccatgcctatgtcctgaatggtattgcctaggttttcttctagggtttttatggttttaggtcttacatgtaagtatttaatccatcttgagttaatttttgtataaggtgtaaggaagggatccagtttcagctttctacatatggctagccagttttcccagcaccatttattaagtagggaatcctttccccattgcttgttttgtcaggtttgtcaaagatcagatggttgtagatgtgtgatgttatttctgaggcctctgttctattccattggtctatatatctgttttggtaccagtaccatgctgttttggttactgtagccttgtaataaagtttgaagtcaggtagcatgatgcctccagctttgttctttttgcttaggattgtcttggcaatgcaggctcttttttggttccatatgaagtttaaagtacttttttccaattctgtgaagaaaatcagtggtagcttgatgtgggagatagcactgaatctataaattaccttgggcagtatggccattttcacaatattgattcttcctatccatgagcatggaatgttcttccatttgtttgtgtcctcttttatttcgttgagcagyggtttgtagttctccttgaagaggtctttcacatcccttgtaagttgtattcctaggtattttattctctttgtagtaattgtgaatgggartacactcatgatttggctatttgtctattattggtgtataggaatgcttgtgatttttgcacattgattttgtatcctgagactttgctgaagttgcttatcagcttaaggagattttgggctgagacgatggggttttctaaatatgcaatcatgtcatctgcaaacagggacaatttgacttcctcttttcctaactgaataccctttatttctttctcttgcctgattgccctagccagaacttcccatactatgttgagtaggaggggtgagagagagcatccttgtcatgtgccggttttcaaaaggaatgcttccagtttttcccattcagtatgatattggctgtgggtttgtcataaatagctcttattattttgagatacattccatcaatatctagtttattgagagtttttagcttgaggggctattgaattttgttgaaggccttttctacatctattgagataatcatgtggtttttgtcattggttctgtttatgtttcggattacacttactgatttgtgtatgttgaagcagccttgcatcccrtagatgaagctgacttgatcgtggtggataagctttttgatgtgctgctggatttggtttgccagtattttattgaggattttcgcattgatgttcatcagggatattggtctaaaattctctttttttgttgtgtctctgccaggttttggtatcaggatgaggctggcctcataaaatgagttagggaggattccctctttctctgttgattggaatagtttcagaaggaatggtaccagctcctctttgtacctctggtagaattcggctgtgaatccgtctgttcctggacwttttttggttggtrggcyattaaktattgcctcaatttcagaacctgttactggtttattcagagtttcaacttcttcctggtttagtcttggcatggagtatatgtcctggaatttatccatttcttctagattttctagtgtatttgcatagaggtgtttataatattctctgatggtagtttgtatttctgtgggatcggtggtaatgtcccctttatcattttttattgcgtctatctgattcttctctcttttgttcgttattartcttgctagcagtctatcaattttgttgatcttttcaaaaaactagctcctggattcattgactttttgaaggattttttctatctccttcagttctgctctgatcttagttatttcttgccttctgcttgcttttgaatttgtttgctcttgcttctctagttcttttaattgtgatgttaaggtrtcgattttagatctttcctgctttctcttgtgggcatttagtgctataaatttccctctacacactgctttaaatgtgtcccagagattctggtatgttgtgtctttgttctcataggtttcaaagaacacttttatttctgccttcatttcattatgtacccagtagtcattcaggagcaggttgttcagtttccatgtagttgtgcagttttgagtgagtttcttaatcctgagttctaattcgattgtagtatggtctgagagacagtttgttgtgatttctgttcttttatatttgctgtggagtgttttacttccagttatgtggtcaattttagaataattgtgatgtggtgctgagaagaatgtattttctgttgatttggggtgtggagttccgtagatgtcttttaggtccgtttggtccagagctgagttcaggtcctggatatccttgttaaccttctgtctcattgatctgtctaatattgatagtgggatgttaaaatctcccattattattgtgtgggagtcttagtctctttgtaggtgtctaaggacttgctttatgaatctggatgctcctgtattgggtgcatatatatttaggatagttaagycttcctgttgaattgatccctttaccactgtgtaatgcccttctttgtctcttttgatctttgttgctgtaaagtctgttttatcagagactaggattgcaacccctgcttttttttttgctttccatttgtttggtagatctgcctccttccctttattttgagcctatgtgtgtttttgcacgtgagatgggtctcctgaatacagcacactgatgggtgttgactctttctccaatttgccagtctgtgtcttttaattgtggcatttagcccatttacatttaaggttaatattgttatgtgtgaatttgatcctgtcattttgctgttagctggttattttgcctgttaactgatgcagtttcttcatagcgtcaatggtctttacaatttggcatgtttttgcagtggctggtactgattgttcctttccatgtttagtgcttcctttaggagctcttgtaaggcagacctggtggtgacaaaatctctcagcatttggttgtctgtgaaggattttacttctcccccacatatgaagcttagtttggctggatatgagattctgggttgaaaattcttttctttaagagtgttgaatattggcccccactctcttctggcttgtgtggtttctgccaagagatccactgttagtctgatgggcttccctttgtgggtaaccggacctttctctctgactgcccttaacattttttctttcatttcaaccttggtgaatctgacaattatgtgtcttggagttgctcttctygaggagtatctttgtggtgttctctgtatttcctgaatttgaatgttggcctgccttgctaggttagggaacttctcctagataatatcctgaagagtgttttctaacttagttccattctccccgtcactttccagtacaccaatcaaatgtatatttggtcttttcacatagtcccatatttcatggaggctttgttgatttcttttcactcttttttctctaatcttgtcttctcactttatttcattaatttgatcttcggtcgctgatatcctttcttccacttggtcaaatcggctattgaagattgtgcatgcatcatgaagttctcatgccgtggttttcagctccatcaggtcatttaaggtcttctcgacactgtttattctagttagccattcatctaaccttttttcaaggttttcagcttccatgtgatgggttagaacatgctccttttgcttggagaagtttgttattaccgaccttctgaagcctacttctgtcaactcatcaaactcattctctgcccagttttgttccattgctgctgaggagctgcaatcctttggaggagaagaggcgctctggttttcggaagtttctgcttttctgctgtggtttctccctgtctttgtggttttatctacctttgttctttgatgttggtgacctacaggtggcattttggtgtggatgtcctttttgttgatgttgatgctatttctttctgtttgttaattttccttctaacaggccccttaactgcaggtctgttggggtttgctggaggtccactccagaccctctttgcctgggcatcaccagcagaggctgcagaacagtaaatattgctgcctgatccttcatctggaagtttcatcccagaggggcacccgcctgtttgaggtgtctgtcggtccctactgggaggtgtctcccagtcaggctacacggggttttgggacccgcttgaggaggtagtctgtcccttctcggaggtcgaatgccatgctgagagaaccgctgctgtcttcatagttgtcagacagggacgtttaagtctgcagatgctgtctgctgcctttcattctgctatgccctgcccccagaggtggaatctagagaggcagtaggccttgctgaactgtggtgggctctgcccagtttgagcttccaggccactttgtttacactgtgagctactcaagcctcagcaatggcagatgcccctccccctgtcaagccacaacgtcgcaggttgatctcagactgctgcgctagcagtgagcaaggctcygtgggcgtgagacctggtgagccaggcatgggagggtatctcctggtctgccggttgcaaagaccatgggaaaagtgcagtatttggtcaggagtgtactgtttcttcaggtacagtctctcatggcttccctcggctaggaaaaggaaatcccccgtccccttgcacttcccaggtgaggcaacgccctgccctgtttcagctcaccgtccataggctgcacccactgtccaaccagtcccaatgagatraagcaggtacctcagttggaaatgcagaaatcacatatcttctgcatccatctcggtgggagctacagactggagctgttcctatttagccatcttggaagcgacccttaatttttggatttttttctgagacagattctcgctctcttgcccagtctggagtgcagtggtgcaacctcagctcactgtaacctctgcctcccgggctmaagcrattttcctgccttagcctcctgagtagctgggattacaggcatgcaccactacccttgcataatttctgtatttttagtagatatgtggttttgccatgttggccaggctggtctcaaactcctgacctcaagtgatctgcctgcctcagcctcccagagtgctgagattataggccactgcacctggctgaatattttttttttttttgagcctgtctctgagtacttttttcatgtagggctcttggtggcaaatttttttagttttagaaagcctcaaatagctttatcttcatatttgctttgaaagtttagatgaatataaatatccagattttaaatttaaagaaattgctcccrttatcttccagtattacattcaatgtagataaagtcagtaagagtctgattctcatcccttgyttaatgatgaattttttctttctctgaggcatttagaattttttaatccttattataaaattttcagcagaatgtttagatgtaaatcttttcttactaatcttactcagcatttcatgaaaccttcccatatgaaggtgcatgtcttatttcagcgtaggggcattttcttaagttattttatgtcattacctttgttgtttgtatcttttgcacttcctatttgagcagctttcaactgttaggacatggyctccgtgttttaaatctatttgtttgtactttacatttcttggtctttctcattgctgttctcagagatttctttgaatttatcttccaggtttaaaaacttggtctagggcagggcacagtggctcacgcytgtaatccaagtgctttgggaggctgaggctggtggatcacttgagcccaggtgttgtgaccagcctgggcaacatggtggaaccccatctctactaaagatacaaaaaataaaaaattagccaggcatgcctgtagtcccagcttcccagcaggctgaggtgggaggatcatctgagcacaggaaggttgaggctgcagtgagctgtgttcatgccactgtactgcagcctgggcgacagagttagaayctttctcaaataaacaataataaaataaaagcttggtcctatacagcatcgaattttaatttcacccatacagtaaatttttcagtgatcatatttttaattttcaagatttcttgttctccagttgtttatttcttcatagacttttcttgttttaagtctgtcatattcttaatcttcctgaggataccaaatcgagattttgcttgttttaattctttccagttctattagtccattttcacactgctgataaagacatacccgagactgggcaatttacaaaagaaagaagtttattggacttacagttccacatggctgggaaggcctcacaatcatggcagaaggcaagggagagcaagtcacatcttatgtggatggcagcaggtaaagatattgtgcagggaaatgcgcgtttttaaaactatcagatctcatgagacccattcactgtcatgagaacagcacaggaaagacatgcccccataatccagtcatttcccactgggtccctcccacaacacgtgggaattatgggagctagaagatgagatttgtgtggggacacagagtcaaaccatgttattccacccctggcccctcccaaatctcgtatcttcacattcagaaccaatcatgccttcccaacagtcccctggggtgttaatttatttcagcattaacttaaaagtccacagtccaaagtctcatccaggacaaggcaagtcccttctgcctatgagcctgtaaaatcaaaagctagttagttacttcctaaatacaatgggggtacaggcattgggcaaatacagccattccaaatgggagaaattggccaaaacaaaggggctacaggccctatgcaagtctgaaattcagcggggaagtcaaatcttaaagctccaaaatggtatcttttgactccatgcctcacatccaggtcacactgatgcaagaggtgggttcccatggtcttgggcacctcctcccctgtgctttgcagggtacagcctccctcccagcttctttcacaggctgacattgagtgtctgtggcatttccaggcatatggtgcaagctctaggtggatctaccattctggggtctggaggactgtggccttcttctcacagttccactagatggtgccccagtagggactctgtgtgggggctgtgaccccacatttcccttctgtactgccctagcagaggttctccatgagagctctgccctgtagcaaatttctgcctggacatccagttatttccatacatctctgcaatctaagcggaggttcscaaacctcagttcttgacttttgtgtacctgcaggctcaataccacatggaagctgccaaggcttggggcttgcatcctctgaagccacaacctgagctgtaccttggccccttttagtcatggctagagctgctgggacacagggcaccaagtccctatgctacacacagcgggggtctacaggcctggcccatgaaaccactttttcctccttggcctcccggggtgtgttgggaggggctgccatgaagacctctgacatgcctggagacattttccccattgtcttggggattaacattcagctcctcgtttttaatgcaaatttctgcacctggcttgaatttctcctcagaaaatgggattttcttttctatcacactgtcaggctgcaaattttccaaacttttatactctgtttccattataaaactgagtgcctttaacagcacccaagtcacctcttgaattattttctgcttagaaatttcttctcccagatcatcctctgcctaaatcacctctctctagttcaaagttccacaaatctctagggtggggcaaaatgctgccagtttatttgctaaaacaaagcaagagtcacctttgctccagtttccaacaagttcctcatttccatctgagaccacctcagcctggaccttattgttcatatcactatcagcatttttgtcaaagccattcaacatgtctgtaggaagttccagactttctcacattttcctgtcttctgagccctccaaactgttgcaacctctgtctgtttcccagttccaaagttgcctccactttttcaagtatctttccagcaacaccccactcctggtaccaatttactgtattagtccattttcacactgctgataatgacatacccgaggctgggcagtttacaaaagaaagaggtttactggacttacagctccacatggctggggaggcctcacaatcatggcagaaggcaaggaggagcaagtcacatcttatggggatggcagcaggcaaagacagagattgtgstgggaaactcccgtttttaaaaccatcagatttcatgagactcattcactatcatgagaacagcacaggaaagacctgcccccataattcagtcatctcycaccaggtccctcccacaacatgtgggaattacgggagctacaagaaaagatgtggctggggacacagagccaaatcatatcaccagtgaattgtatttttatccacttcctctatggtacttgttctgttggttttctcagtcttctctttcatactgtcatttttccttatgtgtcctcaaatttttctttaatgtgtttgctactcatatatctgactggaacattactcgagttattataatagcaaggatgaatttccagtagctcaataggtcctttttctagcagactcctccactgaagttaaaaaatttctggtgacctcattttttaacattcactatgttattaatataaccattttccgatgccaaaaattctaacatactaattttattggttgcatagtttttcatcatagtactgtttactctttctcttattattggatatttgattttttccagcttttcattaaataacatcaagaacacatttgtacatgtatttcttcatgtatctctgatggttttctagtgttaattcctagagtgaaatttataggtcatgaaagatttctaatagacattgctaaattgtcttttggaagattgtaacaagtctctgtctcataaaaataccctttccccgcagcactcttgataatggcagatcatgttctttttaatctctgctaacttagcaatatacatattacaatatatatatagaatgtgaatattttcctgtttgaatttacatatttgggtgttttcatgagtttcttttgtgaattgactctttatgttctttgcctgtttttctgttcaccattttgtttcgctttgtcagactttattttgggaatgttaagtgctcattataattactgtaagttttttctcagtttgtggtttgcctttaacttttttattatgtgtcttttgctaaatatatgttttgatgacatatatgtaaagccacccactcacctgtccagagattaaatttcatctatatagcttggtatgtttatgatttctagttttacattaaacttttaaatccatgtacatttatgttggaatatggcttatatagggacacatctttgttttttctgaaataactaattagctagcatctttttcattgactggtagttcatcctttccctattaatttgaaatctcacctctgtcatatacaaaatgttttttataaatatgtgtgtgtatctgcctagaaataacttgtccaggcacatcttacaattcttgacatttctaacaagaccactctgttactttactgttttagaaagcacttaagtataatgcttaatctactgtattaaaactgtatacaacagccaggcatggtggctcwtgcctgtaatctcagcattttgggaggctaaggcaggaggatcatttgaacccaggagttcaacaacagcccaggcaacatagtgagaccttgactctacaaaaaatttaaaaattagcttggtgtggtggcatgcgccagtggtcccagatattcaggagtctgaggtgggcactcgcttgagcctgggaggttgaggctgcagtgagctgttatcactgccactgcactccagcctgggtgacagatcaagagcctgtctcaaaaacaaaaaacaaaacaaaaaactgtatccagkgcttgtgtattatcctaatttctaaaaatcaatgaccccccaaaatatttccctcatcagaatgttctgttatcagccaaagatttctttctgtcagctcacatcctgccacaataaaggcaaacagtggtagacagggtgaaccattgtgattctgaagcattctaagtggtttcagggatatgaaagtttcatcatcctgttttgtggtaggggaaaaggaaatattgttaaagtaaacattgaaatttgaggtaaataccagtattcgaactttgaaaaagtagccagaatgttcctaaggtggcaacatttcagaaattatacaatttctcaatgccgctagttattggaacagttctaaggctctgcccatgtgttgacatcacattccatctcccttgttcttatagggcttcagccacacagctggttaaggtgcaatttgaccatgactttcttaagaaatgaaaggtacattatggtgctgtaggtcaaatgtgaagtatgtgtcctattttgtgaactattgtagcaaaactaaatcaatgaagggattttgctgagaaagtagttaccagcattcacaaagctggctactgggtgaaaaacctgaattctgagttttgcaattaactgcataacactgagtattacctaataatgattcctttgtttttttcagttccttttgcattatataggtgttttcccaaatgtgttctgaaagacattattgctgcaaggtgctctggaagacatttcagggaccatggttaaatcagttaaagaaaagctgtgtactagatccttctctaagaaatgcactggctgggcacggtggctcatgcctgtaatcccagcacttagggaggccaaggcaggcagatcacttgaggtttagagttcaagatcagcctagccaaaatggtgaaaccctgcctctactaaaaatacaaaaaatgttagccaggtgtggtggcatgcacctgtagtcccagttacttgggaggctgaggctatagaatcacttgagcccaggaggcagaggttgtagtgagccgagagcatgccactgcactccagcctgggcaatgggaatgaaaccctgtccaaaaaaaaaaaagcacaatatgtagtctcatactaaaggctttaagaagtcttacagaaaagaaatttaaatcttttggatctatttcttgacatctgtaggaactgtttcataaaatctactttaggaacctgtattagctgctgtccaaggtatcaaacgtctataattctagttccagtaaaaagttgtatataaataacttactttatatgtagtactttaatttgtaatatcagtatggaatcttcttaaggaaacactgaaaaaaacctttaattgtacaagatctttgtacagtatcatggacttttaaacacagaaacacagagaagtattgttttgtcctgtgaataccaaaactttgatttggatttattagtgagaaaaaagcaggatcaaacgtttycctactttttaggagttctgtgcaatacctcaaattctatccagaatgttcctacaaagtacagtatgatgttagacactctttacatccaacatgttttcttttgtttaatttaatttgagctattattggctcaaaatatatagattcttagtgatcttttatatttattgttcataaaataatgttcggcttcctaataagaaagtgaagaggaaaatcaaggtgttttcatcttgcttgtaggatgggtgctgcagacaatatatataaaggacrgagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtaagtatccggtaaactgtatttaaaaagaaattaatttgtaaattattatttttaaatgacagtcataattgtgccatatttatggggtacaatgtgatgttttgaaacatataaacaatatggagtgattaaattaacctaattaacacattcctcacctcatttaaatatcattttttgtggtgagacatttgaaatttctcttagttattttgaaatatatattattactgctgtagtcataataccgttatgcaatccctgcatacccttttgtacatggatgatacatattatacacattattttcctgatctcagtctccaaatactcaaaattatcttttttataattgactgcagtcctgcaagtgatcattagaatgctacacactgaattcagacagattgaccctaaataatgtttgtagttttttgatatatgttcctttttttgctgactcaacataaatctggttgtacgaaaaaggccttcctggcaatattttcactcagaattatatcttattatccttggtgaaccctaaatcaagaacaggtaccatccatctacagccaaattcctcgagggaaaaacaaggaaatagtgccatttccactttgtgaaatcctttttttcaccaacatcctgaaggatctcactgtgagatctttgatctcatctctttgtgtttctatctgattcagtaacatcattccttcaatacatgtctcctttttttcagggtgcatttctaagcttcagtgtaaaattttgtttgtgtcaaactttctatccctgtcatttccatctaactctctcctttagtttactttctctatcttgttcattttggtctctgcttttcaaatctccccttcatggcacctctccttaggtctttcccttctctggtctttctttctgttttcccccccattttcttgctcctttgtcattgtgtcttccctcattttcatttctttctctcttccttaaatagccaataaaatcatatttttaatatttcttttcaaaaagcaacacaaaaataaaatgtatttttctttaaccttttgttgccattggtgttttggggtttagttttgtttttaaagcttaatttccatttaatttttttccagaagatagtttttcttcagtctttagagactcagctccatgaacaggctttgatggagatcatggggcagcatcctcagatctaaattggagcagagttgtttggtcctctaggcttcatgagaatgattcctgactaccttgctgtgagcggcagaacttgtgcagtaatacagtttcatacactgtttgggaagcacagagacatcaacgacactcaatttggaaatgtccctgacagctgtaccttctactatatttcaaatgacaaacttctaaatagccttgtccttaggtgtgcatccaacacagtttgtgcagcaaataggttgtacctagctatggccctttttggcacaaccgttgttgttgttcctcctcctcctcttctttctcttcctcctcctcctcttttttttttttttttttttcttttttgaaatgggttcactctgtcactcaggctgcagtgcagtggcatgatcatggctcactgcagcctcgacctacctgggcccaggtgatccttccwcttcggcctcccgagtagctgggactacaggcacacaccaaccatacccagctaatttttgtattcttttaggaatggagtttcaccgtgttgcycaggctagtcttgaactttcaggctccagtgatccacctgccttggcttcccaaagttctgggattataggcatgagttaccatgcccagcctcccttcttttctttgttattttggcagtgaagacccaagagtgactcaggttttgtttaaacatttatttagattacataggtaattataacattttgttttttttaaggaattttttgttttgctttaaaaaatttatttgcaaaaagatgtaactcagaaactttaatcattatagaaactacgtaggaaatgatgagttcatgtcctttatagggacatggatgaagctggaaacgatcattytcagcaaactatcgcaaggacaaaaaaccaaacaccgcatgttctcactcataggtgggagttgaacaatgagaacacatgggcacaggaaggggaacatcacaaactggggcctgttgtggggtggggggaggggggagggatagcattaggagatatacctaatgttaaatgacgagttaatgggtgcaacacaccaacatggcacatgtatacaaatgtaactgacctgcacattgtgcacatgtaccctaaaacttaaagtataataataataaaaaaaagaaactacataggaaagcaattgacttttgtacattaaccttggatcctgcaaccttgctgtaatcacttactaattccagtctgtgtgtatgtttgccaattcttttgaatttcctacataggcagtcatgtcagatacaaacagacagtttcacttctttcttccccatctatttttttttcttgtcttattgcagtaactaggactttcagtacagtgttgaaaaagcagtaagaaaggatatcgttgccttgtttctgatcttagtgggaaagctttgagtttctcaccgttaagtatgatgttagctagaggttgtttgtggatattccttaccaaattgaggaagttctcctctattcctagtttactgagagtttttattgaatgggtgttagattttgtcaaatgctttctgtgcatctattgatatggtcatgtgatttttcttctttagcctgttgatgtgatggattacgttaactggtgttcaaatgttgaatgagtcttacacacttgggatgagtcctacttggttatggtctgtttttctttttatacattgttggattcattttgctaatattttattgaggatttttgcatctatgtttatgagagatactggtttatagttttcttataatgtctttggttttagtattaaggtaatgctggcctcatagaatgagttagaaagtatttactccactcctgtcctctgaaaaagactatagagaattggtaaaatatcttccttaaacatttggtggagttcaccagtgaagccatctgggcctatgattttggttttagaaggccattgactcaagttcttcaatagatatagacctattcagaatttctgttttttttcttgtgtgagttttggctcattgtgtcttttaaggaattgtttttcaagaaattttcaccaargttaccaratttgtggacatagagttggtcatagtattcctttattatccttttatttgtccacrgcatccgtagtgttgtccttttcatttctgatattagccatttgtgtcttttctcttttgttcttagttagcttgactagaagcttatcagttttcttttcaaagaaccagcttttggttctattgattattttccccattgctttcttgttttaatttcattgatttctgctctaatttttattatctcttttcttttgcttatttttgctcttctctttctggtgtcctaagatagaagcttagattgtttattttaaattgttctttttttctaatgtgttcagtgctataaattttctttttttattctttcttttctttccattttttcttttttgagacagggtcttgctctgttacccaggctggactgcagtggcatgaacatagcccactgcaacctcgactccctgggctcaagtgatccttctgcctcagcctcccatgtagctgggactacaggcacatgccacaacacccagctaatttcacttttattttttatagagattggggtctcactatgttgcccaggctggtctcgtattcttggactccagtgatcctcttgccttggcctcccaaagtgctgggattacaggtgtgagccaccgctcctgrcctataaattttcttctatgcactgcttttggtgcggttccacaaattttgataaggtgtgcttcctgtttttacttagttccaaatattttaaatttctctttatttcttttttgacccatatgttttttaagaatgtgttgtttagtctccatgtatttggggattttccagttacctttttgttatgattcctagtttaattccattgtggtatgagatcaaatattgtatgatttttattatattaaatttgtcaacatgtgttttatggcccaaaatgtggtctttcttggtgaatgttccatgttagcttgagatgaatgtgtattcagctgttggttgaagtatctatagatataaatgatgtctagttgattgatggtgttgttgagttcagctgtgtccttactgattttctgcctgctggatctgtctgtttcagatggaggaattttgatatctctaactatagtagtatgttcatctgtttctctttgtagttctatcagcttttgcctcatgtagtttgacattctcttgttaaatgcatacatgttaaggatattatgtcttcttggacataagacataatatcctttatcattttatcattatccctttatcattatataatatccttctttatccctgacaaatttacttgatctgaagtctgctctgtctcaaattaatatagctactctaacttcctttagaaattaatatagctgcttcagctttctttaatgttaacatgatgtatcttcctccatatatatatatatattttagacagagtctcactctgtcacccaggctggagtgcagtggtacaatctcagctcactgcaacctctgcctcccagattcaagtgattcttgtgcctcagcctcccgagtagctgggattacaagtgtgtgccaccacgcctggctaatttttgtattctttttaaattaaagatggggtttcaccatgttggccaggctggtcttgaactcctggcctcaagtgatccatctgcctyggcctcccaaagcgctgggattgcaagtgtgagccacctcacctagcccctccatatatttttaatatgtagttatttttatatttaaggtgagtttcttgtagacaacatacagttaggtcttattttttgatccactctgataatctgtcttttaactggtgcatttagatcatcagcattcaaagtgattattgatagagttggattaatatttaccattttttacttttttctatttgttgttcttgttcattgttcctacatgtgtcttccactgtttttctgtcttatgtggttttaactgagtattttatattatttcattttctctctttttttttttttttgttttttgktttttggtttcttggggtgttttttgaggtgggatcttaytgtgttgcctaggctggcctcaaactcccgggctgaagtgaccttcccacctcagcctcccaggtagctgggagtacaggtgcatggcactgtgcccagctattttctctcctttcttagcgtatcagttatatttcttgttttactttttctagtggttgtcctggagtttgcaatatacgtttgcaactaatccaagtctactttcaaataacactatattgctttatgagtaatgcacgtattttttaataacaaaataatcctgattactttcttcyatcctttgcaccatcactgtcatttatttcacttatacttaagtgtacataagcatatatatatataaacatacataatcgcatacactgttgctattattattgtgaacaaaatgttatgctagatccactaaaaataagaaaaataaaagtttttcgccttcactggttccttcttcartgctgcacttttctttatgtagatacaagtttctgacccctgtcattttccttccttctaaagaactttccttaaacatttcaggatagatctgctggctacaaatcctcaatttttgtttgtctgagaatgtctttatttctccttcagttttgaaggattattttgcaaggtacagaattctaggttggagaggtttgttgtttttttttttttttcctctcaaaactttagatattttactmcactcttttcttgcttttgtggtttctgagaagtcaratgtaatttttatctttgagcttgtgtggataaggtgtttcttccctctggcttacttcagtattttttttttctttatctttggttttctgtagtttgaatatgatttgtctaggtgtggttttggggacatttatcccgtttggtgttccctaagcttcccagatctgtggttttgtgtctgacattactttggggaaattctcagtcattattgttttaagtatttcttctgtttctttctctctttattttctctctggtattctcattagctgcatgttatatcttttgtagttgtctcaaactttttggatattctgaggtttttttctagtctttttctgtttgcatttccattttggagatttctattaagatgtcctcaagctcagagattcttccctcagctgtgtccagtctaccagtaagctcatcaaacacattcttcatttccatcacagtgtttttgatctctcgtttccttttggttttttcttagaatatgcatctctgtgcttacattgcccatctgttattgcatgctgtctgtgttaaccatagagcccttagcatactaatcagttgcttccaattcccagtctgataattccaacattcctgccatagctatgtctggttctgatgcttgctctgtctcttcatatttgtgggtttttacttttagtatgtcttgcgactttttcttgacagctggctatgatgtattgggtaaaaggaactgctgtaagttaggttttagtaatgtgctggtaagggtctaggggaggagtcctatgattaagtctcagtcttacctccctcccacccctcaggtgggataggaaggctagagtgggctggagttgggtatttcctttctctcatatggaaggctagaggagactggagttgagtctttcccttcccccaggtaggtgaggctttgataaaaccccagcaggttaggctccacttaagtagtttcttctgagggcagaccttgttaagaacagagtgccctggtgcatttcaaaatagttctttctttcttccccttgcctgaagcataaggggaatttactccagtgtttattgtgagaaccaagtggaactcctgggagtaaaactcacaaaagtgtgcccccttcccccatgactcggttcccctgyactttttgactctcagacttgttgacactgagcctccagcaattgatcagttccagttccagttttcctaccctgatactggttccttcagaggtttctgcctccatttcagctcaggaaagttgtgattctttgtatctgcttgtctgtctctaacttgggggacagtggtttgcctgtgacttcatttttcttacagatctaaagagttgatttttcagttggttctactttttccttgtgatggagaggyaacctccaaccttcttatatgctaaactggaaaccagaaacttccctgacctttttrtggatgaaaatctttattttcatggttccttctgatctctggatagggaagagagatcagaaaggagcaataagggaggtcatgtgttgctgctgcaggccgagaacagccttgaggagcacagtgtcggatcccagacccttaggtcttccggctamaagtgcctatcagcttggagaaggagcaccatggagataggtggtcctaagatccctcrgggcagattttaagcacagctttttaaagaaatcctgccttaatacgtttatttgttattgttatcagaaagaaggcacacattcagacttttaataaggtgaatggcaggtgaatcaaaactggagttctttgatttaattacctccttctgccaatatttaggctaagattggtgttaactttcctccagatagaggtttccagaatatataaaatatgccttaaaataatgcttattaaagaatccatgagactgggtgcagtggctgatgcctgtaatcccagcactttgggaggccaaagcaggaggaccccttgagcccaggttcaagaccagcctgggtaacatagtgagacccctctctacaaaaaataaaaacaaaaaattagccaggcatagtggtgcacacctgtagtcctagctacttgggaagttgaggtgggaggatcccttgagcccaggagtttgaggttatagtaaactatgattgtgccattgcaatctagcctggatgatagattgagacccygtctctaaaaaaaaaaaatttgttaattcatactgacactaacaaaaataaactttaaaatggtggaggtgagtggggaaaagtgaaacctctgctttacagaataccaacgaataaatgtaggaagaattttttaatcaacatttaataacgactataataataactgattcagacagcaatgatcaatagattataaaacctttggatgaaagattgttggagaaaaggatattcatatatctcaaagtgtcatgccacaggttatttattaattacaaagggaaaaggtatagtgaagaaatctagtgggtaccctcttcaaccagataatcaaatttggcatccccagttatgtaaaactgatatcacgtcccacctgatgtgatgcactgggaaggacccatcacctacatatacatggaatattcctggtatcgacgaaaagagtcaaactctgtaaaatatttgaagagatttattctgagtcaaatatgagtgaccatggcccgtgacacagccctcaggaggtcctgagaacatgcgcccaaggtggtcagggtacagtttggttttatatattttagggaggcatgagacataaatcaaatacatttaagaaatacattggtttggccgggtgcagtggctcacacctgtaatcccagcactctgggaggccaaggtgggtggatcacgaggtcaggagattgtgaccatcctggctaacacggtgaaaccccgtctctactaaaaaatagaaaaaattagccaggcgtggtggcgggcacctgtagtcccagctactcaggaggctaaggtaggagaatggcgtaaacccgggaggcggagcttgcagtgagccaagatcgtgccactgggcaacagagtgacactccgtctcaaaaaaaaaaaaaagaaaagaaatacattggtttggttcagaaaggtgggacaactccaagcaggggcttccaggctacaggtaaatttaaacattttctggttgacaattggttgagtttatgtgaagacctgggattaatggaaaggaatgttcaggttaagataaaggattgtgggaccaagttttattgtgcagaggaatctctcagcagacttcacagagagagaagaggttgtaaaatgtttcttatcagacctaaaagggtgcctggctcttagttgattatctcgtggatctggaaaggaaggaaaacaaagggtgaaggggatactctatagaatgtggatttttctcacaagagactttgcagggcaatttaaggcgtggcaaggaaatatactccttggggttaaatattttttccttgtctcataatgttgtgccggagtcatattgaaaagcaagtcacaatatacagggtcaaataaaacccatctgatgagaatccatgatatgtagggcatgactccctggaccccttaggtaggaatttgggtaagataaaaaaatcagagtttagtcctcactggcaatgatgtttggaggaaatagcaaagtccaaattgaaagacattatgcaaaacagcataagtgccccctccacccacactctattcctgtacgaaaggatacttgatacttcaaaaatgtccatgtcataaaagacaaaaaaggaaagagacaaaaagaaacattgttgggagaattagggagatttaggaactgtatatgttatataataataatatatttattgagtgtaataattgtattctagttatataggaggatgttttgttcttagaagatagaatcttaaatctttagtgatgaagtgtcatgatgtctgcarctaattctcagatggttcaggaaaaaatgtctgtgtctgtggaggaggaagaagaagggaaatatggtaaaatattaacaattgattatctaggtaaacagtatataataattggtcgttgtacttttcttgtgacttttaggaagatttaaaatttttcaaaagaaagtggaagacagattttaattacaataaaatttaaaaatraaataacatwtattctgtcttattgctttaggtgaaatccttaaccctgtttgtcacccattatccgccagtttgtgaactagaaaaaaattactcacaccaggtggggaattaccacatgggattcttggtcagtgaggatgaaagcaaactggatccaggtatgaaatattcctgcagttggtacaaatattggttttcatgtttgataactcaaagtttgttggaacatgaacttactgcttattaataatgaaagctgtgaatgtgagctataaataacatttgtcaggattcatttttgctaagctttaggtcaagtagaatttagatttatccttgctatctctgagtccttctctggtcttccttgtstcatttgtcgtggcaacccttttctctttttttacaggaatagggtgtgggtggagggggcacttaggttttcctcttagtgccttgtactcttacatgattcatctcagtacagatgacagtcacctgcagagtataattagtcatcttttaaaaacgcccaatattttccccaaaatatcatttaacttactaagrgccatatactgtactggacataggtttttattttaatattataaggaaactgaatctcagacaggtaaagtggtttgaccatgtcaaccacttagatgggggctaaaatgagcctagaattcacttcttctgcttctgggttctcttctgttcccctctgctagagctgctatggaggaaatctacaatatttttcctagtctttccagttactggtgtcacagaaatgagacattttatgaaaaagaacaccgttagccaatagcaatacatttaagtgccataagtaatacagtagactttagcatttttttttctgttcagtaktaattgttttaagccaccagcctgtagtcctgtggtggtttgcgcaattggtatgctgcaatggaaaatccatcatgcaagataccccagagtccagattttattttggaaaagtaatagggatggacctgaaaaagaaatcaggcagctggcccaaataaaacaaagcactgggcctaagataaatgtaatgttaggcagttcctgcttttcaccaccatgcaatcttgaaaaacacatcataaattctcttatggaagtagttttgtatctattaatctgcatccaggttgacaagaggagacttwagctaaaacccttgggacaaagagaatagagttcaccaacagggaagaagaggagtcagtgccgctaatacgcatttgatgtgaactgaaaactaacccagagcattgtacctttcccttaaatgttctgkgcattttattttattgattttaatttttgtgttttgttgagatggggtgtcactgtcatccaggctggagtgcagtggcacgatcatagctcactgcagacacaacctcccaggcccaggtgatcctcccatgtcagcctccccggtagctgggactacaggtgcacaccaccatgcctggctgatttttgtatgttctgtagagacaggctctcactatgttgcccaggctggtctcaaactgttgaattcaygtgatcctcctgccttggcctcccaaagtgctgggattacagggatgagctaccttgcctrgctgattttaatttttatcaatgaacataatttttaaaattcaatggtgctaaaaggctcctgctgacaagcttscatcccttcagttcacgtccttccccatcctagtcccaaggcaactactttcaacacttcccctttctgttgtatttctaagtaatatccgtattttcatgtctcttgcttcatcaagttgacacattattgatggacctctcattgtgttaattgagaatcttcaattttcccttcctctgtccttccagtatagtcatttcacatgtattgtatgtcattcatacttgttgttttcattattattgccatgctaaatattgcttactgatgagccaagtttggagacaagtacatttctttcttttacaacgttttctattttctcaaaaataagaattgactgtcctcattttttccattttgttttgttttgtttttgagtctatagctgaatcttcctgtaccctcagatagcttcgtaaaatgcctctctagatgtttttccacacaactgaacctactggttcccatttgtccactggggcccttcctcctggagccctttgtcctcctgctcatctgaactggctgctgtctgggcctgcggcacagctgtcatcctaagcctgccttgctggcatcctaggagttcccttacccctcttctaagcatgtgattgcaaggaacaaaacactcggtctcacactggctcagacaaaaggatgcagtatatataatcccatgttccatgacttccagaggaagagtgggcttcagctcctcctttttgtaattcccaggctctgtcttcctgcctggccagctttattatcaggctagtgacaatgactgcagctcttcctggcatcatgtccagaatgtccaaaggaagaagagacaagcattkcctgttcactctttcttagaacaagggaactttttctcagatgccttccagtatctcatgattgcctcattgcattttcagaattgagtaacaggctccttcttaaaccactccttagcagaggatggcaggggtgactttgatgggcctagatgaatcaggatcaacttctggagctggctttgaagacccagtcccctgagttaaatgattagggagttaattccttataaaatcaaggttttcttaggggtggaataaatgttgaattaggctactactaatatcaactaaaggaggtaaaagttttgagatttttcatgaatgaaaatgtttcacatgcttgttggccatgtrtatgttgtcttttgaaaagtatctgttcatgtcctttgcctattttttaatgggtttggttttttcttataaatgtaagttccttatagatggtggatattagacctttgtcagatgcatagtttgcaaacattttctcccattctgtacgttgcctgtttaccctgttcatagtttcttttgctgtgcaaaagctttatagtttaattaggtcccctgtgtcagtttttgcttctgttgcaattgcttttggcctcttagtcatgaaatctttgcccgttcctatgtacagaatgataaaagcaaaacatcactgaccattagagaaatgcaaatcaaaaccacagtgagataccttctcacaccagtcagaataggtattattaaaaagtcaaaaaataacaggtgctggtgaggttgtggagaaaaaggaatgcttatatgctgggtgagagtgtaaattagttcaactgttgtgtaaggcagtgtggtgattcctcaaagacctraagacagaattaccattcaacccagcaatcctgttactgggtatatacccagagaaatataaattgttgtgtcataaagacgcatgcacacgtatgttcattgcagcactattcacagtagcaagrcatggaatctacctaaatgcttatcaacggtagactggttaaagaaaatgtggtacaaatacactgtggaatactatccagccataaaaaacaataagatcatgtcctttgccggaatatggatgaagctggaggccattttccttagcaaactaatgcaggaacagaaaaccaagtgttgcatgtttcacttataagtgggagttaaatgatgagaacacatggagacatagcggggaacaacatacactggggcctactagatgggggagggtgggaggagggagaggatcaggaagaataactaatggatacaaggcttaatacctgggcgattaaataatcagtacagcaaacctccgtgacacaagtttacctctatagcaaacctgcacatgtacccctgaacttaaaagtttaaaaaaaaaaacaacaactctatagcttccatgttcgaatttatagttcagccaggattagaattttagattgaaaaccatttcactcagaattttgaagcagtgctccactgcctgctgccttccaatattgttcctggctatatctgtgcttcatccattacctcttccccaacttctcctcttctgtatgaggtagaggccattgcgtaggtcatcagtaaaatgccccacaggtcttttggatggcttctataatactctatttcctatgatgtgataggtaaaacaatggacaaacagttaagaaacctgtgttttagtctattccaatctgtatgatcttgaacargtcacctaacttcactcacccctaaatttttatgaatctgttctaaaagcaacttcagaaattatttgtcagtacacatctctttaataactgcttagagaagtttggcttaaatataaatcttgctatgtttccccataataagcagaaacatgaattattacttccactgactcaaagcagtgccaggtaaacattttaataatgtccatttaagaaatggccatagcttgtaagtagttacatcctcatcaagaacttttgctgtgagcctgtaaagaaayagagtttttctcataaaacaagttttattctctcccatgtggctttttctgactccatatttccatcctaccagcacccccaacccctctcgcacacagaggttaaaggagtacataattacagaaagagatcccccaggcgattatagawgagtggttgcgttctttaccttgaagatatgagaactaccataatttaaagtggagaccagcatataatgatacactcagcaactgtttgtatgttaacaaggtattcagagcagtgaaatattttatgtaagttagctatattttgtagctatattatacattatatatataattatataagaacattgttacaactatctcttgtgcactctttatatatgtatacatatatacatatatatacatatatacatatatatatacatatatacatatatatacacacacacacacacacactatataaaaaaattaaaagtcattaataggctgggcatggtggctcacgcctgtaatctcagcactttgggaggccaaagtgggcagatcacctgaggtcgggagttcaagaccagcctgaccaacatggagaaaccctgtctctactaaaaatacaaaaagtagccgggcatggtggtgcatacctgtaatcccagctactcaggaggctgaggcaggagaatcacttaaacccgggaggtggaggttgtggtaagtcgagatcatgccattgtactccagcttgggcaacaagagcgaaactccgtctcaaaaaaaaaaaaaaaaaaaattcattaacaaatttttggatagggggattttgtggcatttatcaggctcccagaaaatactgatggctggatggatggatagatggacagacagacagatgaatgaatcttgtttagaaaggtcagcatgggatctagattatattggagagctggagacagggagatcagttaggactaacacagttgaagtgataaactatttttctgtcttaaagttaagaaatggctttttttgattgcctattgcctttcacttcactcttagtcttgtgaactttgaagagttacaaaaaattatccaggtttgcaggcactggcttctagctgcatcttccctaatctgttcccacctacttccgcacctgtgtttctcaactttcatttgggggcaaaaggtactgtsagtgccttgcaacggaagtttaggtctgtgtttctgagtgagttggcattctttccacctcccacttcagcacccacccttggaaagctcttatctgtctgctgccgaattcttagaggagggccaggaaaaatccattgtcctttttctctgtcatgttcagtctttggctttttaaattttcactgataaaagaagaaaagcatacacatctatcaaatgaaataatgattgagaaaaagcttttaataaactcataagtatactgggattgtagaaatctttgtaactcttgtccaccttggacatttctgcagcacagtgcacattttgcagcacaattatattgaatttcataataaaagttacataatatcctgagctgctttagcttaaactacatgcagtggtttatgataattattgtacttcattatatcccagttcttttaaagttttaagttcatgtgtatgtatatatatgacaggctgggtcctctaggaggcagattctgagatttgcattcaggaggttcattsggagtgctgggctgtgttatggtcaaaaggcttcagccagccctgcagagaactctgaggctagagtggtccttcagagttacctcaacttggggtgagggggatagacctctatacctttattagttatctctattagtttggggtaatttgcaaacagtgtgcaacagattaccccccaaaacatagcggcttagaacaacaaacatttattacctcataatttctgtgagtcaggagtccaggtgcaacttagctgaacacctctaaggctgaaaactgtagccctgtaagagaccctctagttcggttcctcacagggctacagtcagtcactaatcagggcagcagccatgtcaaggcttcccagcccacacatggctcttgccaagcctcccaatatctgcttccaagcccactcatgtggctgttggcatgccttaggctctcaccaactgttggtgggagacatcagtttctttccatgtgagcatctccacagacagcccacaacatggcggctggcttccctcagagcaggcaggcaacaaaatgagagtacccaagtcagaagccacaacctttctgtaacctaatctctgaagtgacatctcatcacttttgccgtattctgtttgttagaagtgagtcactggttaggaatgatacagagagggaatgacacaagcacgtgaacaccagcaggcagaggtctttggtggccatcttagaggctgcctacaacaaccagtcactggctgtaggctgccccaaagcgggatgtggtcttgggtgaagcccctcccttcagctgcaacaatttccaaagaaggcaaacagtcgagggttgcaggccagcaatctttctgacagctgagggaataaactctttagtcctaagtgggatctgggtggtactgaacagaatccggtatgtatagctcttagttaacctgaatatttaataaaccagaccatcttaatcctgttatttaaactggccaacatgtaatattttcttttctgtttttaagggagaaattataggcctggtatggtggttcatgcctgtaatcccagcactttgggaggccaaggtgggtggaccacttgtgcccagaagttcgagagcagcctgggcaacatggccaaaaccccatctctacaaaaaaaaaattagctaggygtggtagtatgcacctgtagtttcagctactcgggaggctgagatgggataatcaccttgaacctggaagattgagactgccagtgagctgagattgcgccactgcactccagcatggatgacagagtcagaccctgtctcagaaacataaaaaggagaaattatattgtatcaaccacgtactaagatcattctcatcctggcgcagtggctcacgcctgtaatcccaacactttgagaggccaaggagggaggattgtttaaagccaggagttcgagaccagcctgagcaacatagcaagacctgatctctacaaaaaatattaaaaaattagctgagtgtggwggcatgaacctgtagtcctagctacttaggaggctaggcaggaggattgcttgagcccaggagtttgatgttacagtaaggtatgattgtgccactgcactccagcctaggtaatagaacaagaccctatctctaaaaaagtaaataaataaaaacattctctttttaatatagacgttcagttcaaatttgcaatgaatcattgttaaaaactattttaagtgaactaaaagatagatcctatatgcacacagcagtttcaaaacagtatttacccttttctagacatatcaaattgataaatggatctaacaggcaagtaggaacagtgatttcagattgtacgatttaataaagttatgagaacttacatgtcctttttaatcctctaatttatttcagctttcaggcacagttttgatctcctttctttatttcacaggcrcagcagaacaagtccctgattttgtcrccttcctttaccaaataactagaggaattgcagcaaggagttatggattaaatgtggctaaactagcagatgttcctggagaaattttgaagaaagcagctcacaagtcaaaagagctggaaggattaataaatacgaaaaggtcagagtgattatgctgcattttttcatttgtaatgaaaccttctaagttgtccaagaaagagaggagcgtcctawaaatgaacatcaggtctacttttaagcacctcttcaaatattctgaaccatttaattatgatgaagtgaaaacagctcttgcaaagctcaggtgaattcagtccatcttcattagatcattattaagttgctaaattggtttttcggtcatttttataaagaattaagttaactccttaatatgtgccacattcattactttaaagattcagtatgccaaaggttactgaagatattgagaacctacagaagatttcttttattcatagattttattcagatatgcaacgattrcatccagaaattctatcagagcattaatgaaaataatagtattacataacaggcaatcacagtcartatccacatgtcacttattttgtagattgtgacaaatttttcattctaaacaggctgctgtcactttaaatgcttatgggaatactttccacctttacgcttgctatccagctagtatgtagtcagtayataaattaatcttaatgtaaacctgagatacactttgaaagaaagatattcctagaaaaatatcatattagtaaattatacccttttgtttcccaaatataaaattctaaaacaacataagctccccatccacctactgccccacccctgccgtacttggggagcctggtgtgctgggtacattagtaccctggttgataatcatatgaccatgatgaacagattgttgatcgaatagaaaatcttggctggctactggtggtccctgtgttatactccaataatattctttaatatttggttataattctgggaattattaccaaatttcaatattgaaatagtaatgcctatcatactagctaaagaaacagttgctaacttgtttaccaaagtacagtagtgcagttaacttctctttctctacctccttctcctgtgcttccgccttgyactcctccacttcggtatactgtagttcaccaagtccagagtgctggactctacaaatggcacacagcctcctctagtgacactcttttctggctcatttccaaattgcaatgccaaaacagaagcaaagtggcataatcagtttcagcctatttctgttacaagccagattaatataaaatttttcctgagggaaaagtatctatgagaatttaaaaataaacttagccctcttcctctgcaaagtccagagacaaattaaactctttagttgccatattattattgktctttttctctgaaaaaaacctagaataaaactttactacaaaggatatatatacaagatagtaataaaatatgtcaatttctaaatttgctgtagaaatatatgcaagatagcaataaaatatggcaatttctatattttcatatattcttgtttctgctatatagcctataaagcaagagcaaaaaaactctcagattactcataaatattttaactcttccaactagtaagtgacattttgaactctatgaagttatcttgacaagatgagagaattattagaagacattgcattgggatggaatctgatcatttatcaagatactgtatttgttattttaccttttttctaaaagtgcttatcacatcaattcctttggccagatcaaagaaatcaaactgcatcttgggccttactgtggatttgttataatagttgctatttgttggatggttactgtgtgtagaaaccattctgagcagtcatttgcagcagcctacacactgtgccagctactcttctcatcactttacatacattatctcatttcatccttatggcagccttatcctcatggtatagttggggaaagtgagaccagcaaggacaggacactgacccagagtcacacagctacttgatggtggagcagtaattggaactcaggtactctagctccataccctaaatagtcaattgggttgctattctgcagraaaaaaaaaaaagtaagtctgtgttatgctggcgttttactctttaattagcttcattgttttcggttggtgttacttttcatcctgggaacacttcataggagtttcttttctccaggtacaaataagcacacaccaccagcctctagcagagtttgaaggaggaggaggtcaggttctcccctctggggctggcaggggtaaggattttaggagaaggcacaaaggtaatagtggcaattggtaacctgggtcccttgattatagtagcagctctgaaagctcctttcactggaagggtgacactgacacagcttcctaactatagagcctgcccggtattcaagtgttatagacttttcatagcttctgatgagacgtattgtctcccagcaatttcatttattaaataagtagtatttgatttttccccagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcrcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctatagatgatggtatgtcccattgaattttggtgtttccaagtgtttggaaattgtcattttttaaggtgtaattatgaaattaaggttactgctttgaccagcgcaatacacagaagtgaacttgttcatttgggacctttctgttcattaacatatcaggtgtatcatcttcccagtaatgagccttatagcttagttgattcataacagtgctcccttcctgcaaatttagggtaacacgtgctcaactgtgtccctgggttttttacagcacttacaatctggcttcccagatccatgtgttctttttgtttctaaatatatgatcttgcacaaaagctctccatcctattttcctctcttttattatttctgctcagttaaatgtcttccccacatttgatggacatatttttaattccttcttctggattattatcttcagtgatcccagcaatgaccccagccagacacaggagtcaatacagtgtccccaagttgtggcttcacttttgagtcagtcactctttagctatctgactctcaaccttattggagttagagtgtgatgtaatttgattgattctaccacccctccagaaatatgaacgtatagtcagattctcaaaactgtcaaaatagttagttggaatgtacgctttaaattttaaaaagaacaaaattgttccaatactctatataactgtaaatgtcttatattttttctaacaagatttcaaagatagtgctgtaacctcacctcacagggagaaaaggagataactccaggaatttcatgcccatgccagagggagctgcagggaccagcaatcactggtaatgtccaggtggacatctggagccacctctccctcttgcttggtccaggccagcatcaacactgaagcaggtaggggttccaggagcattgtgtcctggcagtggcagcacacagtgtctggcagctgacaacgtggaactttacagggtagattgtccagcatgatcaggaagccagccaggcggccagcttgagggaaggcaggcctcctccaagctggggaagagatcagcacagctgaactgcatttccaagtgagactcatccccagctgggttactgagatattggaggaaacgttgaggccaaatcccagtcataaagactgcacaaatgccatggggaggtaggcagaaagttgcaaacaagtgggtttgtatttcagataaccatcttggggctgcaattctaaagttagatataatcacacaggtgagaatagggctgctggtgcatggcaagcgccctccacattccctctggtactgcataggcatgagcctgcaggctaaatgtcttccatacttcagacagaggctaggggagacagggctgactggtggccaaatgtcaaggaaagtaactttttaatacgatatattcctttaagtgacttgtccgtttttagccatcaaattacaaattaagagctagtgattctgcagtaacacacaccaattcctcgaaaaccttctaaagtcacaccagtttaataattccaaccttagggaaacaaagccaaacatattttaacaagtttgaactttgacctttctattgcttcatctctcctcagtgctgtttattctatatagtttttaaaatagtgttattatataactagtataaaatatttgaaaatccatgggactatataatttaaaaagagaaaaaaggaaaaatgaatttttaaaattaaattttgtaaggtaaaaataaatttaaaggctgggcgtggttgctcacacctgtaatcctagcactttgggaggccgaggtgggcagattgcctgagctcaggagttcaagaccagcctgggcaactcggtgaaaccccgtctctactaaaatacaaaaaattagccaggtgtggtggcatgcgcctgtagtcccagctactcgggaggctgagacagaagaattgcttgaacccaggaggtggaggttgcagtgagccaagatcacaccactgcactccaccctgggcaagagagcaagactctgtctcaaaaaaacatttaaaggaaaaaaaatataaaaacctcagcatttgagttacttaatttatctcaatgtttctcagtgctgaatatgaaaatcaaatgattcccatttgaatcatagacttttggactgagatccaagcttagtattcttttatcagctttattgacatagtttacatactgcacaatttatttagagtgaataattcagtgggtttttgtgtattcacaagcttgtacaactgtcactacaatcaattttggaacattcttaatcaccctaaaaagaaatgctgtacctattaactgccagtctgcattcctccccaagatcgtcagccctagacaacccctaatcttcattctgtctctatagatttgcctattttggacatttcatatgaatggaaccatagaatatgtggtcttttgtgtctggtttctttcacttagatgcaagattcatctgtgtgtcagaacttcattctctttaactggtaaaaagtattccattttatgtataccttacattttaatttatccattcattagttgatgcacatttggattgtttctatttctagctattatgagtaattctaccatgaatatttgtgtataggtttttatgtgacgaggcataatattttttaaaaagctcccctagtaattctgatgtgcagtcaggtttgtgaaccattagtctcaaagatgacagatgactaaacagtatttttaattgagttgacaatcatttggtctgtttgtccactgctttatctgtcacttagggcagagtgtagcatactgtagaccctaattaatatttgttaaagtggaaaagaaaaaccaaactccttcagcttagaaacccaatgaaaagatgtttcttttcataatgaaggcaccatttcactagggattcaagatccatacagaagtgtgctatatctttagaaaaaaaaactttttcagacaatttttccaagtttgtgcctgtcgtcatcatggtgatggtgttggggctggtgaaacactgcccactgcatcaattccagagtaaaaactagattgaatccaaaattttctataaattartgttgacctttactgagttctgagatcaatattaattactgctgtgctttgtaattataaaagggctatttgatgtttcacaccaaggatatgggtggagagagaaaagaacttgtattaacaccatctgtggtttctaactttgtaattaaggccaattcctctgtggaacattttagttattatatatcatgattattcggtctattaatatccagggaagtaccacagtttgagagccattcattctggtttacttggggagtcctattctatacctgttttgctggcataattattaaaagcctctttaactcaaaagtgtcctgttttggataataactcatacagttaccccaattataggtgctattccatgagcacagttactgacttgctacattttaaatgtcatctaaaaaatttttcatttttttcttacccattggatgaaccagtttttcccctaaagacctgccagttgtttttgcctgttcttgataagtgctttgtattgtggcatttagaagctacagctctgctaattggtgtgttagagctttactacttaatctgttgttgaggctaaatccccaaagataacatgtcatctgcctcttctccacgaaatcatggtgaggaatgtgcacctacatgactttgtgagacacgcagcaagactgtcttcttgcagaaataattattcctcaggaggaggaattgcctctggttcttttgtcctttgctcagatcctctcttcattgcctttggctatcttttttttatttttttgacaaaacagtattttattttcacatcagaaaagaaatattgtctgccattttcacctctttttcaacctcaagcccctttttcttaatcctacttccagaaagctcccatttggaggtaggaatgtcttgccctcttatcagaagcaccaaaggagtttcttaaatgtggatttctaggccccgccttaaagctactgaacctgaatctctgaagttgggacacagaaataccagtgttagtttctgtcatcccttcatcacgttctctcaccttttccttcctcatatggccaatgatctggcctccaaagaaatttgttaaaaatcatattccttggttcatgactgctctttacgattctgtctgatttactgcatctggtgtggggtctagggaacttcattattatttttaaaatagactatttcttagagcacttttagattcatcacaaaattgaatggaaagctcagagaggtcccacataccctctgctcaaacacaccacctccctcactattgacatcctgcaccgtggtggcatgtttgttacggttgatgaacctacattgtcacaacactatcacccagagttcgtaatttacattggggctcactcttgatgttgtaccttctatgggtttggacagatttctaatgacatgtaatcaccattatagtatcacacagaatagttttactgccctaaaagtcctctgtgctctgcctatgcatcccactcaccccaaaccactggcaaccactgatcctttcactgtctccatagttttgccttttccagaatcatacagtaggtagtcttttcagactagcttattattcacttaataacatgtactcaagcttactccacgtctgttcatagcttgacagctcatttcttcttagcactgaataatattccatcatctggatgtaccacagtttatccattcacctactgaaggacatcttggttgcctccaagtttgacaattatgaataaagctctgtaaacatctgtgtgtagctttttacgtggacatacgttttcatctcatttggataagtaccaaggagtgtgattgctggtaaatgttgttttgtaagaaaccaccatactgtcttccatagtgacactaccatttcacattcccatcagcaatgaatcagagttcctgtggctccacatccttgctagcatttggtggtatcagtgttatggattttgccattctaatagtatgttgtggtattccattattttatcttgcatttcttggatgacacgtgatgtggaacatctttttatatgcttattggtcatctatatcttattcggtgaggtgtcaagatctttggctcattttttgatctggttattcattttcttattgttgaacttcaagtattctttgcatattttggataacagtcctttatcagctatgttttttgtcatctgtggcttgtcttctcattctcttgacagcgcctttcatggagcagaagttttttattttaatgaggtccagcttatcagttctttctttatggatcatgcctttggagttgtatctaaaaagtcattgctatggccaggatcatctagattttctcctcttctatctgctaggaattttgtagtttgcattttacaatcgtctatttgatttttttgtgaagggtgtaaggtctatatctagttcttttttaatagactttattttttacagcaattttaggctcacagcaaaattgaatggaaatataaagaggacacttgatttttaaactgagtatcctaagtgattcctttgcaaataaagactcaagttttaaaaagcacagccatattgccttcaaaatgttattcatcagaagaggtcacttctgcaaataacagtgggcctttaatttctccaagctttttagattactttttaatggaatatcaggcaaaagcaaacatttaaattgcatttttgtgttatgagatttaaaggagtgtctatgaagaggaggcataatacttcaatctt

SEQ ID NO: 12379 - DNA, 67126 bp, Homo sapiens
  misc_feature (1)...(67126): n = A,T,C or G, or insertion/deletion polymorphism (see Tables 1-2)
aaggcaggtggatcacttgagtccaggagtttgagaccaccctgggcaacatggcgaaaccccgtctttactaaaaatacacaaattagccaggcatggtggagtgtgcctatgatcccagctacttgggatgctgaagcacaagaatcacttgaacccaggaggcagagtttacagtgagccaagatcacaccactgcactctagcctgggtgacacagtgagactcagtctcaaaaaaaaaaagtagaaaactcatcaagctgtacagctaagttctgtatacctcatatatgaatattatatcttaattaaaaggaaaagtctattaacaaaaagagttctcaaaaatgctcaacctgaacctccttagggggttggcagaagcattaactaaagctctcctatatttcaccaaaatgtgttggcaattcgtagcctgctggaggaagggaggtgtgagctgttccctgtgttcagctggacagcctcccactctctataggcgcttcttttagagccagctccactgctggtcctggaggttttttggggaaggcgatcaaaaaatttacaatgtccatgactactatagggaatagttctacgatgctggctgcgaaaaccagatcaacttattaggcacagtagacacagtgataattttactgtcccatgaaaatgttttaattttaatttcttttgaaatcagaacaaaaataagaatactgtaataatgagcatataataatgaattcagccagcgttatatgtgtctttataatgcaattggaaactctcattttaaatttttttttttgaaggaaaaaggggtccttaaaggcaaaggtgcctggggcccacacaagtcataatgcagccctgagtaaaaggaaaggtgctagggactgaattgtgctcccccaaatgtcttgtgttgaagccctaaccccccaaggtgactgtatttgaagataaggcttttaggaggtaattaaggttaaataaagtcataagggaggggccttaattcaataggattgttgaagaagaggaagagagagagaaatctttctccctgaaagcacacacttaaggaaacaccatctggggacacagggagaaggtgctgtctacaagccaggaagagagccctcaccaggaaccaaataagctccccatgctgawcttgaactctctaacctctagaactgtaacagataaattcctattgtttaagtcacaccagtctttggtattttgtgcaatggcctcagaygtcactaaatgacattgattacattctattaccccaaaaccctagttctatcttcattttctgttattgaactttaggcttcaggttaggaactaggcaagcttgcaatttgttaggtaggtaggcattctttttttctctgcctatttgaaggactacctactttgaaggttgcagatcagcagcagaaaaaaattttttaaaaagctttttaaaaaaattttagaagaaatcaaaggtttttttggtaataaaattttattggcttggcatggtggttcatacctattatccagcactttggaggctgaggcaggaggatcactttagccagggaggtcaaggctgcagtgagctgtgatcatgccactagactacaacctgggtgacacagtgagactctgtctcaaaagaaaaaagaaaaaagcacagaaaaataaataaaattacttataaatgtgtgaaaagatttttaatctcacttataattaaagaaatacaaatcaaagcatcctaattttattttatttatttttttttttgagacggagtcttgctctgtcgcccaggctggagtgcaatggcgtgatctcggccactgaaacctccacctcccgggttcaaacaattctcctgcctcagcctcttgagtagctaggattacaggtgtgtgccaccacgcccagctaattttttttttttttttttgagacggagtctcgctctgtagccaggctgcagtgcggtggggcgacctcggctcactgcaacctccaactccctggttcaagtgattatctcacctcagcctcccgactagctgggattacaggcatgcaccaccacccccggctaatttttgtatttttagtagagacggggtttcactatgttggctaggatggtctcgatctcctgacctcatgatccacccacctcagcctcccaaagtgctgagattacaggtgtgagccatcacgcccagcctaatttcttgttgcccagactgcagtgcaatggcgcaatctcagctccctgcaacctccgcctcccaggttcaagagattctcctgcctcagcctcctgagtagctggaattacaggcatccaccaccatgcctggctaattttttgtatttttagtagagatggagtttcaccatgttggccaggctggtcttgaactcctgacctcaggtgatccacttgcctcggctcccagagtgctggaattgcaggcatgaaccaccgcgcctggccaatttttgtatttttaattgagacggagtttcagcatgttggccaggctggtctcgaactcctgacctcaggtgatccacctgccccggcttcccaaactgctgaaataataggcgtgagccaccgtgcccagccccaatattttttaaaataagaaacaaaataaataaaatcacagattgcatttaggtacttccatacattgctggctgcaatttctttggagggcaatttgacaacaatcaaaacttaaatacscatttcctttgatccaacaatataaaagtatttccaacagttctatttgcgcatgattgcaaagatttacatccaagaatgggccaggagtgstggctcacgcctgtaatcccagcactttaggaggctgaggcaggcagattgcttgagcccagcagttcaagaccaatctgggcaacatggtgaaaccccgtctctacaaaaaatacaaaaattagccaggagtggtggtgcacaggtgggaggatcgcttgagcccaggaggtagaggctgcagcgagccatgatcatgccactgcacgccagacttggcaacagagtgagactctgtcccagaaaaaaacatttttaaaagatacaaggatgttcattgcatcatttccagtaacaagtgacaagctaaatgcccaagaagagactgattaaataagttacatagtggatcaaaaattattaacgtaagtatttctagccttcccctaccatctgccagctacagataatttagtcttgggtcaactttctcctctccctctacaagggaaatgttcaaaagtgtttagactttggtgatgcagcatgattgggaaagyagagggcacagaaagatgccaggctttgtggtctccaggcaagctcaggaatgtgacaaagcataccgaaaagaaaagcgggctgggagcagtggctcacgcctgtaatcccagcgcttcaggagtctgaggctggtggattgctggaggccaagagttaaagaccagccaggccaacatggtgaaaccccatctctaatgaaatccaaaaaaaaattagctgggcgtggtagcgcacacctgtaatcccagctactcgggaagctgaggcatgagaatctttggagccggggatgtggaggttgcagtgagctgagatcatgtcactgcactccagcctgggagacagagcaagactctgtctcaaaaaaaaaaaaaagaaaaaaggaaaaggaaagataaatttataatgtattgccaggaccacacaaacccttcatatgtaccaggaatgcaagtagaggaattgagttattttgaaatacttgttggctggtgatttatatttcattgatttagacactgctctgagtatggcttcagaagtgttacatacgcataataaaatcctttacagctattaaaaggagtgaggtaggaaagcatactgctaaaagcaaagaagccagatgagaactgtgtactgtacatccccacttgtttaaaacgtttgtatattatattcacatatgtatgctttccactacatagaagttttctggaaggtatttctgcacatttataaagatgcacatctaataatttcatttccccccattttctacttattgctctgaggtcaacactgaatagtccttatgaagatggtattgaatattctttcaacaaaaaagtctccggatctcaactactggagctcagaaaacgataccccaaagtaggaggctttggcatgctaagtactttgaactaaaggagattaggtctcagtagcagcctcagaaacaaagtctacccatgactttctcctgccctcctgtctccagcggtcttgcacccctgaagtaagtcacaggaaccagaattcttcttccccaaggagggttatggaaacttagaaccttcaaagtaatttataaacttggaaatcttactgtaacattttcttctacctctctctgtctttgagacagggtcttgctctatcacccaggctggagtgcagcagcatgatcatagacaactgtagcctcctgggctcaagcaatcctcctgcctcagcctccttagtagctgagactacaggtgtgtgccactatgcccagctaacttaaaaaaaattttttttttgtatagagggagtcttgctacattgccctggctgagaatttacatttctaacaagttccaaggagatgctcctgctgctggtctggggatggccgtttgaggatccctgcatgaaggcatacacaggacttgatcctcagtgggggcaccaggagctggagcctggggagtgggaagcgagagcacagagctgactgaggaccacgaggtcgtcgtggaggacctaggctgaaggtcctgaagaaatccccatagtttcactgccaggccagccaggtggacatctcagggctgaggaggtgagaaggcaagacagaaagtgaaacagcactttataggatagggatgggaaggtcatctgcatcatgggactccttggggaggggttcggtcattgctccagatgaaggtttagtcttttcatcgtaaatttgctttcactgttgggaaagagatcttcacctccattttcttaacttcaaaatggaaatgacagatgcttttgagtggtctgaatacttgaaatttgagggaaaacgttaccagaaacacatacaactagagttaaagataaatacatatatcaaacgcatggctcaaaaatgacaacgcgtcttctttatctgccttcacgtagaacttaaaacagaccctggtccccacctcgggrtttcctcgcgcccacgggctgcgctgcgcagctgggccagcaggtggcgaggctcccgcactttttttcccgggcctggccgcaccgccaccgcccaccccgcgctccgccccgccccgccccgccgcactcgcggatcgtcacacggtcaggccaccgcgcgtcaccgccccgggctctgctagaaagtgccggggtccagattcctttcaggtgactgggttgggaggagaagtcgctcagcgtaattgtcggagccgaaataaacagagactccgcggccgggcgggaccttacccggaagtcccccagaacagcactacccttcgctgaaacctcgcccgccccctccaacccagagacgaaaagggaaagcatcacggccagaaaccgttggcacaactccacagatactctcccgggccgagccagactccataagtcccgcgcctggcccccggggattgcaggggctgaggagaagggcaacacggggaccttgaagcggggtcgcggsggcgccccagcccgggccagggagtcccggcagcggcacctcccagaaagggcggagccgacgacgccttcttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgagcggtcgccggccaccgggacgccctgtggggacgtggcggggccgagagccggggaaggcgacgggcccagcgacggctcaggcccgggtcctggggaagttggtctggcgatggagagctcggaggttcctcacttgtcctgtttctgtctccggccacgctctctttcctgtggtctggaagagggtggcagtgggggcttgggtgacctgttctgagcttgttccatctgtggtcacctaatttctctgtgtaggatgtggcaccagaagaagggaggaaagtgggtagagtgggatagggacactacttgctttttaaaaaattctgctacatgcgcacgaactccaaaatttaggagctctaaccactttatttcctcttctcatcacctgaggatggaggtggaagcagaggtaaagagacacaaacttcctcaagcacccggtgaaactgccttgagtacttgacataagtcagcttggtcttctaaagagggcaggttacttttcatcaactcctttttacacctcaggacactgagactcacagggcggtattgaatttccccttgtcactattagccagcgacaggatggggcctggaactcggtgtcctgctgactccttctgggggcttttgcttggtttaatagctttgggaaagagcacctcagtatttgtgtgtctgtagtttcctcttttaaaactggagtggggcagtgtcacgctgtgactcgttaaaccaaatcaggatgagagtgcctccggggaattgtgtccttgtgcacattaacgcccctcacataggtgtggcgtcaataggaagtggtgartcaggggagagggggttccgtggactagaaaaaactctccttcgacttctatttagttctcagaaggggataggtgatgttgatccaataatggactaagagccaggagaagggctccgcgggaggatctcttgagctcagcagttcaagaccagccggggcaacatggtgaaacaccgtcttaaaaacattttgtttttcttttcattgttgaggttgaggctgctgtgagctgtgatcacgccrgtgtactccagcctgggcaacagagcaagaccctgtgtcaaaacaaaaaagagagagaaataaataatagcaattatgtgccktagagaaaatgtggctattctgtttccctagagttttttaaaatttatttttaaaatttatttattttagagacaggttcttgctstgttgcccaggcgtgggggcagtgtcgccatcatagctcactgcagcctggaactcctggcctcaagcagtccttccaccttggcctcccaaagcactgggattattgtgagcaccactcctggcccctcctagagttttagatcaggaccttaaataggcttcccttttttttggagacagagtctctgttgcccagtctggagtgtagtggcgcaatctcggctcactgcaacctctgcctcctggattcaagcaattctggtgcctcagcctcccaggtagctaggattacaggtgcccaccaccacgcccagctaatttttgtattttccgtggagatggggtttcaccgtgttggtcaggctggtctcgaaatcctgacctctagcgatccgccctcctcttttggggattacaggtgtgagccacctcgcccagccaggcttcacattattaagtagccatctcttaagtattttttaaatctcaagtacccaaggctgatggccaatgagtgcttcttttatgacatttgggataggtcagaggtttgttgtaagtctcttgcaaaaatgcctggaggccttttcaaggtctgtaaaccttaactggaaataatcctattattattttaaaaattcctcatgtctgaaagctttcagtgcacctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtcatctaaaaactatatgcagttttgagacatagcctttatttttcccggctgtaattttggtaagctttatcttgagggacttggaacatagagaagcctgggtagaaattaagcattaaaatggcttttcctcagaagactgggaatggttaatcttttgacctgtgagtgattaagaacaaccatctgaaattggaatgactgtgggaaatctttccccatctttcccactccttgactgatgctgtgatcagaaattttactaacataagtaatcaaggggaaaatgagatttttttaaatttgagccagtgggcagagggaaaaggactcgctgaataggcctttgtattcctccagtgtttgttatattacccagaacaaagaatcactctggtcatgaagacagtgtgctctctctttcctgggtaaccctccactcctaaaagggatgcagtattctaagcatggcagattacctacagcggaagcctggatcagtcatctctgatctcgggtgcccctttctgscctttgacctccagctctgtgaagggcatcagctctccagtcaaattgaactgcttgctagcaaaatcctgcccatcttccagggccccatttcacatgctamattatctacgacatycttgtcctgttsccctaactagaatgccttccctctgaagttctgaatctttatttaaactgctgcaacagcatttgctgcctcattaaaagaccttggtgtgggtcttgactcttctctgttcccaagagtgatcttgggtaagccagttatcctctggagcctcagtttcctcctctgtaaaattggattaactgtgccaactatgcttgtgaaagacaaatatttcctaattgaactaccgaattgcaggctccttaagagcaataactgttgctctccaatatcatctacaaatgtggccaggacacttgacttgggactctttttttttttttttttttttgaaacagggtcttgcactgtcccccaggctgaagtgtagtggtttgattgtggctcactgaagtgttgaccctgggctcaagctatccttccacctcagcctcccacgtagctgggrctgcaggtgcatgccaccatgcccaactaatttttaaattttttgtagacacaaggtcttgctgtgttgcccaaggtggtcttgaattcctgggctggagatcctcccaccttggcctcccaaagtgctgggattacaagcatgagccaccgtgctggccctggaatcttttttttttttttcaagaccaggtcttactttggttgcccaggctggagcgcagtggcacgatcttggctcactacagcctcgacctcccgggctcaggtgattctcccacatcaagcctcccgagtagctgggactataggtgtgcaccatcatgccctgctaattttttgtatttttagtagagaaggggttttgccagcttgcccaggctggtctcgaactcctgagctcaagtgataccatccacctccgcctcccaaagtgctgggattacaggtgtgagccaccatgcctggcccactgggattctttgatcataagatatttgggccttgaaatggattttggggagagacttagaaactagtggcaatcaaaattggatttgcagttggtttctaggtgatggcagtgatcagctgcggccagccaggtttttcttcatctggactgtgcctctcactttcaaatttttggaacatttgctttggcarcaaaactttyaaaaaaccaactctctctggtgcaggtgttctgttggaggatttgagagaagctttaaaattttatcttattactgtcccttgcttaggtcacaagaggagctcaaaataatttcataaacatgaattggcttccctagacacaacaaaggataagatcaaaagaattaacccatttaaaaaaatcagtctaggctggtcctaaggtagtgtgttatcaattgatcaaagtcagttacagatcgaactccttgatctactctttcctcctgctcactactgcacttgactagtccaaaacaataagtaagtagtaaaaaaaagaaaaaaagtccgtctatacactgtaaagtgctgtgtaaatgttcataattactatcactgtcttcttcatagttgatggrgggaaggctggatacataaaaaaatggtaatacagtaagaagtgctcagataagaataaagataaaatgttatggagagtccatttttgagctgagctatggaggatgaattaatgtatcaggtggacaagaggaaaactagagaaaatagtcgggagagttgcctaattgttgccctaaactattgaactgttcacttgaaaagggtgaattttatggtatgtaaattacatgagtaaagctcttaaaaaaatttgcagggtgctatatactagattacataagactagagacaaaagctacccaaattttgcatagtactccattgctatcacatccgatcttgttttatcctcacagagcccctttaaggtaggtgtaatgctgtttttcctattttatagatgcagacatcaagggtcaaatttgtcccaaggtcacatagctagtagatggcacattgggtgcttcaactgccatcttctgacttctgtgccctagttttttgaaattcaaggctagattattggtgtttagcaagcttaattgaatgggtgttcagcagatattccacttggttagtagagcagtctcattcaaggcctggttccgtccccagtgtggctcttccagtagtccgtaatagatcaggaatgggtttagcctgctggcctgacccctgattcagtcaccacactgtgaacattccatagggaaaaaactgcagacagtgtatactgrcacccactttcatagttttgttttagttttgtggctcctaaatgtctaagactaactagtaatatgaccttgggtgagtcacataaaaaaccagaagctaaaggggttatctgtaaaacgaagagttggactagctgagcacacctagcactcaaaatatatgacttaaacacccacatgcaggcaggcctggtgcacacacaaattatcctttgttatgtagatacgttcatgccaggttggctataaaacacttccagagatttccgtcaatagaagtcagaccagcccggcagcctccaccctaaatgccctgccatatttgtttggtctgcctccctgactccaaagaagcagcaggcagcttaatctctggacaggattcttcatgccactccctccactccagcctgtgttgtcctgactggccaggccagcctctgctctctggagaagcaatgaggtagggaagttaaccagcaagcccctctcctccatcgcctcactggagcttgagctgggtatctctccatgttttgccattagctttacccatccaggacaggggcacaagtgttggtgccaagccctgcactcccagctctggtggatggccaagtcctaccctggggttgaggactgtcagtgatactgagtaagggagtcattgcttgacaactgcctagagagatactttaaaagataggaatgggaggcattatttctacaagtgaacaagtttatattgaaggaacacttgtataggatcatcatggatgggacagttcatctccagtgcattctccaattctgaggatacatcactgcacaaactggactagagtttaaatggtacagaagctgggggtaggggaggcaggaggacaagggggatgggtggagaatgcttaacttggtgttcaaaatcatgttatttatgagccatgtgacctcagagtatctttgagcctgagttcacttacctgtaaaattctgctgtgctactgcatagagtatctgagaaaatgaggcatgcagtcgatgtttggtatttttgtttcatttatttattttactgccatgcctcgagaacaatagatgttcaktaagtatttgaatatgttagttaatgctttaggatttcctaaaggcagtggaatagaattctcactgagttcagagcttttctgataataatgtgtgcttatggagctcctgaatggggtccaatttagcagttgctatagttgctgagatatagcacaaggggcatttttttttttttttagatggagtctctctctgttacccaggctggagtgcagcggtgcgatctcagcttactgcaacctccgcctcccgggttcacgccattctcctgtctcagcctgtagctgggactacaggcacctgccaccatgcccggctaattttttgtatttttagtagagacggggtttcactgtgttaggcaggatggtctcgatctcctgacctcgtgatccgcccacctcggcctcccaaagtgctgggattacaggcatgagccactgcacctggcctagaaggggcttttttttaacctttcctgaactgttcctrtcgttgaaagaagcttccctatccagtcattttcttagtaattaaactctagagcatgttgtgaaatatccatatgatctaacctttaaaaatagaaactctttagctgtgtaactactaaattctgggtagaagccaaaacaatcagcacttctcatttctgaacttagataatccarttgtactccctcagctcattgtgagttttgacaagttctgcatccatgaacaccagatgtaatacaatagggaatttcaaaggaaggattacacacctaggctctgccctctaggattttaccgtcttacaagggagttgagacaaaagtgagaaaatactctggcaacttctcccaacatcacaactttgcaattctcataaattttgcttgatcctagggcatgaccaaggcagaggcaggcaggtcctacttcatgtgggagagaaggaaggaagggtaggcagttagagtgataggtttggaatactgtagaaaggagagtgggcagagccagagtgaggtgtctgaagcttgtcgcacaggcagtgggaagggtgggttggaggtttctgagcaccagaaaactttgagcattgttccggaagaggcaagcggcaggcatctgcaccagagacactgccgggtccgagtgagggcaggaggctgcacgagggagcctccctgggagtgagcgataggttcgctatgggaggtgggttygaaaggtgcctgagattttcatttgaaactctgttgaagaggaattggcaatagaggaggaaatacaaatagaggaaagattggtttcgtcttaagcactgaggctgttgggcagctagtggaaagtgctgctggagagaagctggagatcactgaagctgagagaggggtttgtggatataattagagcagtgtttctagggaggtgcaggtgaagggactgagagagagatgaggttaaaaacacagaagagaaagagatggaggtgtggaggcccctgaggtggagcagctgcagaggcaggcctgggggccaggaggctggctctccactttcagctgttggtgagaagggagtgaaggctgagcagctcccattgtgcagctgttgagtgcacaggtgctcgtgctcttgcacacggtggggtttggggagggtgtgatgctacagggaggactttcatgatgcagctgattctcttttattgagagtctgtttctggagtcacctgctctgttttgaatcctggctttgccactgtgaccttggacaagttgtttagcctcagtgccttcgtttctgcatctgtaaaaggggtataataacgcctccctcatcaaactgttgtaggattaattgggttaacatattgagaggtgacagcgtgctggcagtcctcagagcccttgcttgctctcggcacctcccctgcctgggctcccactttggtggcatttgaggagcccttcagtcccccactgcactgtgggagcccctttctgggctggccaaggccggagcccactccctcagcttgcagggaggtgtggagggagagacacgagcaggaaccggggctgtgtgcggcacttgcgggccagctggagttccgggtgggcgtgggcttggtgggccccacactcggagcagccagccagccctgctggccccgggcaatgggggacttagcacccgggccagtggctgcagagggtgtactgggtccccccagcagtgccggcccaccggcgctgcgctcgatttctcgctgggccttggctgccttcccacggggcagggctcgggacctgcagcccgccatgccagagcctcccaccccctccgtggcctcctgtgcagcctgagcctccccgacgagcgccaccccctgctccacggcgcccagtcccatcgaccacccaagggctgaggaatgcaggcgcacggcgcaggactggcaggcagctccacctgcagccccggtgcgggatccactaggtgaagccagctgggcttctgagtctggtggggacgtggagagtctttatatctagctcagggattgtaaatacaccaatcagcaccctgtgtttagctcaaggtttgtgagtgcaccaatcaacactctgtatctagctgctctggtgaggacgtggagaacctttatgtctagctcaaggattgtaaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtgagtgcaccaatcgacactctagctgctctggtgaggacgtggagaacctttatgtctagctcaaggattgtaaatacaccaatcggcactctgtatctagctcaaggtttgtaaacacaccaatcagcaccctgtgtttagctcaaggtttgtgagtgcaccartcgacactctgtatctagctgctctggtggggccttggagaacctgtgtgtggaaactctgtatctaactaatctgatggggacgtggagaacctttgtatctagctcagggattataaacgcaccaatcagcaccctgacaaaacaggccactcggctctaccaatcagcaggatgtgggtggggccagataaaagaataaaagcaggctgcccaagccagcattagcaacccgcccgggtcctcttccatgctgtggaagcgttgttctttcgctctttgcaataaatcttgctactgctcactctttgggtccacactgcttttatgagctgtaacactcaccgcgaagatctgcagcttcactcctgagcccagcgagaccacgagcccactgggaggaacgaacaactccagacrcgctgccttaagagctgtaacactcaccgcgaaggtctgcagcttcactcctgagccagcgagatcacgaacccaccagaaggaagaaactccgaaaacatctgaacatcagaagggacagattcyagacgcgccaccttaagagctgtaacgctcaccgccagggtccgcggcttcattcttgaagtcagtgagaccaagaacccaccaattccggacacaatgtgaagagcatttaaaatagtgcctaagcctaggacaccgccagtgctttgtaagtctttgggtcctgctggcttaggttgcttctttcggcaggatgactttttttttgagaccagttttcactttgttgtccaggctggagtgcagaggtgctatctcagctcactgcagcctcaacctcctgggttcaagctgatcttcccagctcagcctccggagtagctgggactatgggcatgtgccactaggctcggctaatttttggctgttgttgtttttgtttgttttgtttttttgtttgttttttgagacagtttagctcttgttgcccaggctggagtgtaatggcacaatcttggctcaccacaacctccgcctctcgggttcaagcaattctcttgcctcagcctcctaagtagctgggattacaggcatgcaccccccacacctggctaattttgtattttcagtagagacagggtttctccatgtcggtcaggctggtctcgaactcctgacctcaggtgattcacctgcctcagcctcccaaagtgctgggattacaggtgtgagccaccgtgcccggcctgttgttgttgttgtttttaagagacagggtttcactgtgttgcccaggctggtctcaaactcctgggctcaagcgacccacctgccttggcttcccaaagtgctgggattataggcgtgagccaccacttccagccaggatgacttttttttttttttttttttttttttggtcttctcwgctgtgtctctagaagatgaccttttgagaagcaaacctgaatgttgattcaagcccaaatttcctgggctcaggtgttaattttttaagtctttggaacctctttgccgaggtctcaagcaggtagaagacattaataataattccttatatttgattgcgtggtgctctgtagtttactgagtacttactatatatgtacagataggcccttatttgatcttcacaggaacctgtgaggtaggcagagcttatgagcttcatttcccaggtaggaaaactcctacgtggttacgtaacctgctccaggtgtgatcccaggtgcaatccagctcaacaagcacactgagcctcaggagctcttgggatcagaacccaggactcgatcccactccgtgcygccttctcacccacccctcttccaccaagtgggtggaaatagcacttgctttgaaataagtaacgaatgatctttgtgaaaaggaacctaaacagcagtgggccatctttattcacatctatagtaccaagtgctgagtaaggggattttagactccagacacccgtcctgtttgtcaggccagagctgcagtgtgttgactgcacatctgtctcttgtcactcctgctcctgtgggtaaccagccagagtgcccctgaggcagagacaggccaatccctggagagttctgcgaggtctagggaagagttctttgtatttaaaatttcatgtgaacttcagcagtttcctctgcctctgtagtcagcttttgccttttcaaactttagttagatggataatgacttttactcattaggacttttttccattagttggaaacccagagttgcaatacgtttcttttttccttagaatcaccgggtttatgggaataacaattgggattctctttatataaaaatagtggtggaatcttggcacagggttcatatgtggctttgttgaaggcttgttgtcacttccttatttgtataatttccctcctttgtggcctaaacatgactttcaaagagtcaagaggagttaagtcctaatttttattttagaacatctgaaaaatgaattcagagaaaagtgatattgatgccttggatttccccacacatacaaatcccaatctcctgctgactttttctcatgtttttgggcttcagggactgttgtgggatttgtattttgatactgaaggaccaacacagactgacttagcttcttgcctgtgtgcaggtcatgtgccactgtcactggagagaatttcatgttgtgacttctgttcagatttgttttttttttatggctttcccatcagggttcttgggagccatggctgcttcttgatatcttctgtttccctgtagaacagacgattgcaggcccggggccctggcaagctgggccctctgtggctttctgagtccattgtgaggcagaggatcaggtgcgttttgggcagcagccttcagagcaaggcactgacctgatgattcacactgacccctcccctccgctgaattttctgacaaccttgtgactctcacatgggaaatgtgagtggtttttgagaaatctttacataagaggttttaaaattttcttttgagattgcctcggtgtttttccttaaagttagcacattctttgctttctacttcagcctcaaggacaggaagttcattctygctctttacattggggtgttgatgtttgtggttttgttgttttgttcttcatgttactcatgatgtattgatattaattaamctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtrgcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttgttcgtttcttttctgtttttgagacagaaggagccttgctcttttatcctggctgaaggctagagtgcagtggcacaatcacggctcactgtgtcctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcatgagccacrgtacctgtcctcacttgctgctttcatcataattattaaaggtttcaactttccctggaattactaatagaaatagtaagtagcactctggttgaattgaatcaaacaaacaaaaaaccctaagaagacataaaatgattgtcaggagaggagagaaagcttccaaataaaaagaaaattagaaacatctctacttgtgaataaatagtaaatgtgtagccttttaaaataattctataataactttgcaaatacaggatgtgtcttacccttttgtacttcaaaaggattacrtgaatgaatgtgtcttagttcactgaggaatgttgaccttactctaactgttgcctactcccgtgtctgtgctctttcacctgaaaggaactctgtccaggattcttctttggcaatgtcagtctctgttgtgatgttcggcagcttcagacactaaaagacaacctgcagctgcctctacrgtttctgtccaggtaggttctgctggggaaacagaacaactgggctgtagatacttgtgaactggtaatgctcagctttccatttattctttgtttacatatttttatttattatatgtctatattatatgtatattatatatttatacatatatgtatacatgtaaagtaggtgaatatatatttatgtattaaaaatacatgtatgtataatgtgtatgcatgcgtgtgtgtataatagagacagagtctcactctgctgcccaggctagagtgcagtggtttgtggtgtgatcacagctcactgcagcttaaacttcctaggctccagtgattgttctaccttagcctcctgagtagctaggactacaggcatgcactaccatgtctagctaattttatttatgtttttctttatttttttttttttgagacagactcttgctctgtcaccgaggctggagtacagtggcatgatctcagcttactgcaacctcctcccgggttcaagcgattctcctgcctcagcctscccagtagctgggactgcaggcacatgccaccacacctagctaagttttatatttttagtagaggtggggtttcaccatgttggccaggctggtctcaaactcctgacctcaagtcatctacccgcctcagcctggttattacaggctgggattacaggcatgagccactgcacctagcctaatttttatttttttctagagatgagggtctcactatgttggccaggcctggtctcaaatgatcctcccaccttagcctcccagagtgctggattataggtgtgaaccacagttcccagccagttttttttttttttaaagtcagtttttgttttgttttaagaaagcactcttacaatttgtcagaaataaagagaaaaacaataattaccagacttggttcacttcccagttgcattcagagttgatgcttggtttcctctgcgatgttctcaccctgcagggtgtctgcactgcggccaggctcctttcaaacttgagctgtgcactgtggggaagagaggttcctaggggtcctgctcaggtgcctggcctgagactctcatcatgcagtccttcctctccccccatgctttgctttgcacatcattcttgtccctccctctggtgaagggttgtgatagagtcaggtcctcagtagagcyggcctcggggagctgttaaaaattttgttctgctgtagctggctggttttgtcaaacttagttttttatctgttctgttggctatgaccctgagcagtgaaaaagggcttggtaatagatgttcttctctaggcctagccagcaattctcaaatatgcaaaagagcaagctggtagtggtctttagaacagcagattgtggtatctttctaaatttttcagacttcagcacactgataaagatgtttgggaagcaaatattaaaaagggaaaatgcttctctgcacaaatatcactgcaggtggtgatagggcacaagttggcttccagtgaagaaattctgcttcttaccaaaagttaacaatagagaatggaaaaccaccactaaattgttttttcagaacaacaaaagttgaggctgtaattgggccagcatatcctatgaaaggcttgtgaacattgatggaaccaaattggagccttgtacactcagtcaaaacacatttatttaggatccaccgtaggtgaggcattatggacatacggacataaacataaaaagatagccaacctttctccatattatcagaggtaccaaagcttgatttataatagcaaacaggagaaacaacctgatatttggaaaaatatacagctgtcaaaattagtgattgtgggcattaaatgtagtaacatggaaaaggtttgaaaactgtgtaccccaagagtgattcctattagaataatacaattgtggtttctggctttgttgcagtaaagcagtggggctcctgaaagaaagagagtctgtgcttctctgtctccttcactagaacagagactcttgaaggccaggacacacttttttcattctttgtcttacatggtcactgggactgaatcggagtctaaagtaatcttgattgcaagaatgcaagtctaatgaaacagcttttgcaagtaacagtggaccaaagggaaaagagagctcttttatcatgtaacaagtcaacattaggagcttaaactttgaacctgaaggatagcaggcagcttatggttcttgtgcagttgtgtgctcctgaagtgcatgcagccagagaacaacattgctgttctctatctttacaaaccatggggatttctccttgtgtttcaggagggcctagtgattttccggggcttgaaagaaaacctttcaataggttataagatgaagattctcataattctcattattttattttcttcttaatcaaaactgtcagctggtgcagcgctcatgtcgataatcccagcactttggaaggccaaggcaggagggttgcttgagtttaggagtttgagaccatcctgggcaacacagacccacatctctacaaaaacattttaaaaattagccaggtgtggtggtgtgcacctgtagtcctagctacttgggaggctgaggtgggaggattgcttgagcctaggagctcaaggttacagtgagctgtgatcacaccactgcactcagcctgggcgacaaagtgagaccctttctcaaaaaataataataattgtcttcctgatgctccaaagtccctttactctaggtcagagaatgtatgtctctaaattataaagtgcagaattcagagaagcatctctctctttttgaaattataattggacacaataaatgcagaaagtaattagggcattttttaaaggtgtgcctttattttaacatgaagttttaagtttagaattgctggtttttaatatgttctcttggtaatttgtcactttacagtaagtttaaaatattctttgtctatttaaaatcgttcttgctggccctattatgtgtgagatcatgcagaatataatttacttttcctttagatgtccatcctgtttttataacctactgaacctgttttgtgagctgacaygtagccctygacagagtcagtttttgaatgttacagctactgaagattaygttgatcctgttacaaaccagacgaaaacaaatgtgaaagagttacaatactacgtcggacagagttttgccaatggtaagtaaacttttaattattcctcttttacagctggcatcaggacagcagagcaaattgttccttttagttgtcctgtcaactctggaaaatcacaattttcagttccattggccaggaaataagagttgttgctttgcttgtatcctaggacttgaactgcaacgaatataaaaatctccttaaagcgcttgctttaactccccctaactttaacttcccacatggaaaattttagtatgtgcaagtttgcatccatacacttcagtaaccattggatctttgactctaacagacatgagttgtgtaatgtcataaattactgcaagactgagaagatagaactgttaatagttggcagagaagaggtcatgacttgcaagaatcagatcaccataaaggaaagtcagcaggtctaacagatagcagaaatgatcccccagcattgaccaacatacaacatttaattataatgacaaagtaaaaaggtaacaaaaaaattccatagaaaaaaggtctcattcacaaaagcaacaaaaaataaggcacttaggaatccaaaagatgtgacatacaaggcaacctgactgaatggagagaggtcattttgtccagaaacagaagcctgcatgtatggaaagtggatgtgtaacacgtgtgtcattacaaatcattgagagaaaaggtgggctagttgataaatgagatgagaaaatagattatatttatctaattttaatttttacagaaaataaaaaaatcaattgtgtagattaaaaatcccaattggaaagttttagaagtaaatatggaaagatttctagacaggagaggaaaagcagaaaccataagaaaaatatttatgaatataaacaactgttatctagagcagacagcgaaatgcaaatttgaacagtaaactaccatttcacacctcatcagcttggcacaaattaaaaagttggtcaatttcaactgtgggtgaaaatgtgaagcaataggaatactaatgtactccaccacttacaaccataatttggtacaatcgtttcaaaactacttgaaaaacaactttgcagtacgtagtaagttgaagctaaccctcctcccagaaatttsacttatagatgcctgccttagagaaactctaaatgcatataaacctggagacccatataagaacacccactgtaacactattgtgattgtgaaaaattgaagacctcaagaacgagaagacaagacacagactgggagaaagtatttgcaaaagacatrttagtaaggactgttattcaaaatatacaaataactcctaaaactcaataagaaagcaaacagcccaattgaaaaatggacaaaacaacctgaacagatacctcaccaaagaaggcatacagtggtaaataagtacatgagaagagatgctcaacattatgtcattagagaattacaaattaaaacaacgagataccactacacatctattagaatggcaaaaattcaagacgctttcaacaccaaatgctggcaatgagctctcattcattgatggtgggagtacaaaacggtacagccaccttggaagataatttagcggtttcttacaaaactaatcatactccttggtatttacccaaatgagttaaaaatgtgtctaccccaaaacctgcacgtggatatttgtagcagctttgtccataagtgccaaaacttgtaagccaccaagatttctctcagtaggtgaatgggtaaataaactgctacatccacacagtggaatattatttggtgctaaaaagccatgaaaattcagtgctatcaagccatgaaagtacatggatgaaccttaaatcctattactaagcaaagccaatctgaaaagactactcactatgattccactatatgacgttctacaaaaggcaaaaccgtggagacagtaaaaagtcagtgattgccatgggttaggagagaggaaggcataagtagagcacagaagatttttaggtggtgaaaatactctatatgatactataatggtggttacatgtttatatgacattttgaaacaaaagtactacatacttaaaacaagtacacaaacatgcatgggaaggataaacatcaaattcaggattgtgtttaccttagggaaggggctactgtcagggaggggtaattggggagcttcaactgaatctatagagtgtgtgtgtgtgtgtaagtatttttttawtttttkgaagagacgggcctcactgtgttggtgaggctggtcttgaactcctggccttaagtgatcctcctgcctyggcctgccaaagtgttgggactgtaggtgtgagccaccacacctggcctatagtgsattattatttttatttagtttttaaattatgccatagccagttgttytgaatagtgcagtactacaaaacagagtcaaggtctcatgctgtcacccaggctggaatacagtgatgcaatcatggctcactgcagcctcaacctcctaggttcaagtagtccccctgggtagttggaaccacaggcatatgctaccacacctagctaattaaaaacaaatttttttttgtagagatagggtcttgcttttttgcccaggctggcctcaaactcctggcctcaggagatcttcccacagtgctgggattacaggtgtgagtcactgcacctggccragtccattatttttttaatgttgaggcaaatgttgtgaaatggtatgactgatagttaactgggtaatgaggaaatgagaattgtattattctccatgtgttttgtatgcttgaaacataaaataaaacctgaaaaccaaatggtgagctggaagatacgagggaattactcagaaaacagcatacagatacaaagacctataaatcattaaagaaatgacatataacatgagaagctccagagagttggggagagacaataataatcaaagggataatgaggattttccagagtggataagggatgaaccctgagaacttagagaaaattcagcatacaaaaatcagttgtatttctgtacacttgcaatggacaatctcaaagtgaaaataaaacaattccatttactttagtatgggaaatacttaggagtaactataacagaaggcaaaacactttaaagaacagccgggtgcagtggctcacacctgtaatccaagcactttggaaggccgaggcaggcagatcacaaggtcaagagattgagatcatcctggccaacatggtgaaaccccatctctactaaaaatataaaaattagctgggcgtggtggcgctcgcttgtaatgccagctacttgggaggctgaggcatgagaatcacttgaacctgggacgcggtggttgcaggagctgaaattgtgccactgcactccagcctggctgacagagcgagactccatctcaaaaaaagaaaaacagaaaaaacacactaaagaacattattcagcgaaattaacgaggatctaaataaatggaaagacattccatgtttatcaatcaaaagacttaatattgtttagatatcagtattctccaaattgttttatagattcagggcaatctctgttataatcccaactgacttctttgtggaaattgacaagctgattctgaaattcacatagaagtttgagggacttagaatagtaaaacaaccctgaaaaaagaacaaaataggaagactcacacttctcagtttcaaaactaagcaatggaaatcaagacagtggtactggaataaagatagacatatagatcaatggaatataactgagaataaataatatatctatggtcaactgatttttgacaagggtgccagggccattcaatgagaaaagaatactcttcatcaaatggtgctgcaataactggatacacacatgcaaaaataaataaataataatgaaattgggccctacttcacaccatatgttaaagaaattaactcaaagtggatcgaagacctaaatgtaagagctaaaaactataaaacaataaaacatagggattaatttgcatggcctcatatttggcacttgattcttaaatatgacaccaaaaacaagagcaataacagaagaaaagattaattggacttcattaaaataaaaaagtttgtatttcagaggacgccatcaagaaaagacaagaaggccgggcacagtgactcacacctgttatcccagcagttcgggtggctgaggcaggaggattgcttgagcccgggagttcaagaccagcctgggtgacaaagtgagaccctgtgtctacaaaaaataattagccaggcatggtggcatgtacctgtggtcccagccacatggttatctgaggcaggaagattgcttgagcctaaggaggctgcactaagtacctcgcactccagcctgggtgacagagtgagactctgtctcaaaaaaaaggacaagaatatatttgcaaattgtatatttgataagggacttgtatctagaatacataaagaactcttggccgggcgctgtggctcatgcctgtaatcccagcactttggggggccaaggcgggtggatcacctgaggtcaggagttcgagaccagcctggccaacatggtgaaaccctgtctctactaaaatagaaaaattagccaggtgtggtgatgtgcgcctgtaatcccagctactcaggaggctgaggcaggagaattgcttcagcctgggaagtggaggttgcagtgagctgagatcacaccattggactccagcctgagggacagagactccatctccaaaaaaaaaaaaaaaaaaaaaactcttactactcaatgatarataaataacccaatttaaaatggcaaaagatctgaatagagtagacatttctctaaggaagatatacaaatgaccaacaagcacatgagagatgctcaatactatgagtcatcagggaaatacaaatcaaaaccacaatgagataccacttcacacccaccaggatggctagaatcaaagtcacataacaagmagtgttgacaaggctgtggaaaataggaacctttattaaaaagaaatccaaaaaccaaaaacagctgggcacagtggctcatgcctataatccagcacttcggacggccaaggcaggtggatcaccttagctcaggagtttgagaccagcctgggcagcatggtgaaactccatctctacaaaaacttagctgggtatggtggtgcacatctgtagtcccagctacttgagaggctgaagtgggaggatcacttgagcctgaggggcagaggttgccagtgagctgagatcacaccactgcactccaatctgtgtgacagagtgagaccccactttggaaaacagtttggcagttcctgaaacaaacatagaactaccatatgacccatcagttccactcacaagacgaaagtataggtcaacacaaaaacttatacacaaatgcttctagcagcattactgataatagccaaactgtggaaacaactcagatatttatcacctgatatatggataaacaaaacatatgtccttgcaatgaaatgttgttcggccrtaaaaagaaatgaagtattgatacatgccacaatatgcatgaaccttgagaacattatgctaaatgaaagaagccggtcatgaaagaccacatattatatgattggatttatgtgaactgtctgaaatagtcagataaatagagacagttcagtggttgcttagggcttagggaagtagggaggtagttgwgcatagctagaatacaggatttcttttgaggtgatgaaaatgttataaaattgactatggtgatagttgcatatatctatgaatatgctaaactccattaaattatatagtttaagggggtaaattgtaaattacatgtaattatattgtaaattatatagcgccaccacacctggctaatttttttttatttttttattttttgtagagacggggttttgccatattgcccaggctggtctggacctcctgagctcwggcagtccacccaccagggcctcccaaattactgggattaaaggtgtgcataaccacccctggcccaaagacaaatatcttaaaagcaaatagagacaagacacaaatcaccttaagacaatgataattggagattttcttaccagccatgatagagcctggaaggcaatggaataatctgttgagaattctgagggagatgactgtcaccctagttaacctgtctttccagaacaagggtaaaacaaaatgaatgtgtaagcatctccttgaagattagggaaagaagatcctgsgaagtttctagcaagcagagactggtaaatgagaatcgacagtacaggacccattccagctattttcttaggtgtaatacactgatactatccttatrtaatgtgttgtgtgtatgtgtaagaaaataaaatccaaaaagataacagtattaggggttttttttgttttttttttttgtttttttgtgatggagtcttgctctgtcacccacgctggagtgcagtggcgcaatcttggctcacttcaagctctgcctcccgggttcatgccattctcccgcctcagcctcccgagtagctgggactacaggcgtccgccaccacgcccggctaattttttgtattttcagtagagatggggtttcactgtgttagccaggttggtctccatctcctgacctggtggtccgcccacctcggcctcccagagtgctggaattacaggtgtgagccaccgtgcccggccaacagtattaggtttattgacacgtgacctctgctctaaaaccagttttccaagtaagttccataattctctggctgtgtagcttcctgcggcagaggttttctggaaccagctttgttaactgaagaagtactgaggctcttagctgcgtcttcctgggccttggtatactcttctatatagtggggatttgacttctccaagctgttgtgagagctatgagataacgtgtgcctttccctttcctgtctgttttttacttttaagttacttggaatcgggcctccatattatttgcagggtgataagccaatttaaagggaatctctgttcgtgcccttagttagtgtttgctgtccagcattccagcatggtgcatatggagttcgtgtttcccttcaagaggccttttgtaagatcttgcctcgtgaattacagcaagcatcttgtctcctttttcctttgggtttcctcttctagcaatgtacaatgcctgccgggatgtggaggccccctcaagtaatgacaaggccctgggactcctgkrtgggaaggacgctgacgcctgtaatgccaccaactggattgaatacatgttcaataaggacaatggacaggcaccttttaccatcactcctgtgttttmaggtaggtataaagattccaagtttggtgtgtttatgatattgttttaaagccaaggaactggctgggcacagtggctcaccagtgcttggggagactgaggcaagagaattgcttaagaccaggagttccagaccagcctgggcaatgtagtgaggccccatctctatgaaagaattaaacattagccaggtgtggtggcatgcatctgtagtcccagctacttgggaggctgaggcaggaggattgcgtgggtccaggagttcaaggctgcagtgagttacgatcatcccattgtactccaaccttggtgagggcaaagccctgtctctccatgaatgaatgaatgaatcttagttgaggaagcataatctacaataggaagataaacacattcaggtaactagttcatagtttctcccagtaagagaggtaactggtacatttatcctgctgtggctaatttagggggtgctgggagtgggaatggaggagsaaatgaattgccttcaggcattgctgtcataattgaaagaataagcagttaaaaagggggtgggaggcagcttttctagagctctgctatagtattagctcctgagaatggagatgggacatgattgaagggttgccttggtatgtggtgtacttggaggattcctctatcagtgacaaacccctacgcgcaagtttattgaggtaacttaaaattccataggacgaagcagcaaaacataatttaattaaactaaaacctccaattctttttcttctttcagttgttttatgtatttcagtgggcttttctttgagtttaagtataatacaaaattttggatgtttttaattgagatttgtactcaacacaattcctttctgtagattttccagtccrtgggatggagcccatgaacaatgccaccaaaggctgtgacgagtctgkggatgaggtcacagcaycatgtagctgccaasactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacaggtaagcagttttgtttgtcatccagggcaaaaagagsaaaattgcccactggcactttgagctttcatttgtcagagcttggttacttaggacaagaaacaaatacctccatgaataccattgcatggattattgtgtcctacagctattctatagtaaaccatcaaagttctgtttaacactgcaacatctgaaatgaattttactgatttattcaaaatgatgtgtgatttaaagcactgtgcattagccactgattctttttttttttggagactgagtctcactcttgtcgcccaggctgaagtgcagtggtgtgatctcagctcactgcaacctccacctcccaggtttaagcaattcccctgcatcagcctcctgagtagctgggattacaggcatccgccaccatgcctgcatgcctgactaatttttgtatttttagtagagacggggtttcaccgtgttggccaggctgatctccaactcctgacctcaggtgatctgmccgccttggcctcccagagtgctgggattacaggagtaagccaccgtgcccagccggccactcattctttagaaagtcagagtcaaggccaggctcagtggctcacacctgtaatcccagcactttaggaggccaaggcaggagaatcatgaggtcaggagtccattgcaaacagccctggcgacagtgcgagactgtgtctcaccaaaaaaaaaaaaaaaaaaaaaaaagtcagagtcaaatgagcgaaatcagattcaaatctaattaaatggagtactatagtccttttagatatttgcatcttaatttaggacagtactttttttactttttattttgaaataattgtagacttaaccaaaaagttgcaaaatggtagaatttatgtgtatccttaacccagtttccccgatgatacaacttacataactcatagtacatctagaactagaaataccatttgacccakccatcccattactgggtatatacccaaaggattataaatcatgctgctataaagacacatgcacacgtatgtttatagcggcactattcacaatagyaaagacttggaaccaacctaaatgtccaacaacgatagactggattaagaaaatgtggcacatacacaccatggaatactctgcagccataaaaaatgatgagttcatgtcctttgtagggacttggatgaaactggaaaccatcattctcagcaaaatatcgcaaggacaaaaaaccaaacaccgcatgttctcactcataggtgggaattgaacaatgagaacacatggacacaggaaggggaacgtcacrcaccggggactgttgtggggtgggggcctgggggagggatagcattaggagatatacctaatgctaaatgacgagttaatgggtacaacacatcaacatggcacacgtacacatacgtaacaaacctgcacgttgtgcacatgcaccctaaaacttaaagtataataataattaaaaaaaaaactcatagtacaatgatcaaaaccacgaccatgccattattattacattattattagctaaaccagagatcttaatcagatttcaccagctttttctctaatgcccttccctgtttcaaggycccatattacatttttgtgttttatgagtcccctctaatctgtgacagaaagttcctcagtctttccttttctggccttaacactcttgatgatactggtcaggtattttgtagcatgtccttccatttggctttatctggtattttctcatgatgagattgaaataaggtgttttgacaagtacatcacagaagycatgttatgtctttctcggtgcatcatgtcagggatccctgatgttgatgcgtctctttcctggtgatgttaaccttgatcacttgctcaaggtgatgtctgctggctatctccactgtgaagttactgcttttcccttcgtaattgataaatatcttgggggaagatgctttgagactatactaatattttgttcctcctgaaactcaaccactgattttagcattcattgttgggtcttgtctgcaacmgttataactaaggtgtttgcctgatagtgattttyttctctttccctctcttcctctgcatttactaacyggacttctgtacagaaagctatcccttctccctcatttatttactcagttatttacatcatggacttttaattctgtgggttgtatccaacactgtcatttatcttgttactcaaagttttccactttgggccattgggagtgccttctggctggcttctgtgttcttacatacacctcccatccccagctttatcttacatattccctgtccctgccctgcaaggagctctggttccttttattggagaatggtatgtagaaacgaagatctgggcactaggtaygctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcctcagcctcccaaggcacgtgccaccacacccagctaacctttttgtatttttagtagagacagggtttcaccatgttggccaggttggtctcgatctcttgacctcgtgatcccgcccaccttggcctcccaaagtgctgggtttacaggcgtgagccaccgcgccyagcccagtagtgtgtttttaaaggacctaaaagttttaaataaaatgagggccacaaggtgaaattatcctttattaattgttctcttaacatcttcttaaattttctcctgagactggtgagcagagggacccagagcaaggggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggtaggcatatttgtccatgaataaaagggttcagatgatgctgtctgtcatgagagcattcgtttcctcagtggggttgcagcagtgggtgaggtggtgtgccagtgccgaggacacggctgcgaccaaggcagacatggtccttgcctttgtggcccyaccatctagtcagggtggcacagcagaaccaagtaattaatcatagctggggaggcgcgaaagcagcaggacaagagtgggaatagcagggcagggttgaacctcacccttcagaggctcctgtgtcggcatctcctctgtggggtgggaatagcgctcattgagggcagccaacaaaggtggcttygctgagcagataggtagctgagggcaggggtctcatatgtgtccccaggtgggcttgattcctgccatgagatagcaactaatgctttccctgttcygactttcaggaacggcttggctcttaacctccaccttcccttcctctcccgttcttccaggagaggcgtcytgctgtgaccctgtcagcgcagcatttgagggctgcttgaggcggctgttcacacgctgggggtctttctgcgtccgaaaccctggctgtgtcattttcttctcrctggtcttcattactgcgtgttcgtcaggcctggtgtttgtccgggtcacaaccaatccagytgacctctggtcagcccccagcagccaggctcgcctggaaaaagagtactttgaccagcactttgggcctttcttccrgacggagcagctcatcatccgggcccctctcactgacaaacacatttaccagccatacccttcgggagctgatgtaccctttggacctycgcttgacatacagatactgcaccaggtaacctgctgtttgaagaaataagtcactctagatgaccttgtggtttgctggcttttacatgttkactactgctagatggggatttggggctgaatgtcatggtatatcttgaaaatcttagcgtataatggcaaagctgcctttaagttaggtttcaagaaagtgaatgatgttgaacttaatggaatatttattgttgctcacttttgtatttacttcagatagtagaccttgcctttttcttgaaattgagatgagcagagaaagaagacttcagtggcgtttctctattgaggcaggatatatttattaggaagtcaccttaggaatttgtgaaatgttttctgttggtaactgaaagtaatatgcaaggacccagaggcatgaagcccttactgctgtcctgggggctgaggaaggagctgccagattaccatccctgatccaacctgtaggaatgaacttatcactcactgcctgaacatgggcacccagcctgtttttggtgagaggcgcatttggggcaagatccatcccattgctcctagaaaggcatgtaaaccttcccattgtccctgtcacacttgccttggagaactgtacctgtgcataaactgtaccggcttcttttttaatgaatgtataatcacatggtttttcctttaaacattgctcatgtctacaagaaagtctgcaatcttgaaaagcattaaaatggtcccaagacttgaatcttttctctacccagtgactgtctgttgctttttccagcttgttgctgaaggtgaacagcatagtcatttacctccaagatcatcttctctgttaggaaataaggggacatatataaatggctgtagtgcagagcaaggcaggaggttatgtgttactattgagaggagggtcagggagaccaggagtccccctccactctcccctctggcctgctggccaccactggagaacggtggaggggagatggttgtgtgtcctatgttgatagctgttctggtcatggtgttccccctacccctcgccgcctctgtggacgcctctaactagtttgctgttagagtgggcctgtggcctgaccagttttcttactgtattgcatcttaattctctccctcatcttaggaagtattttccccaaatactctttgtcttctgaccctcagggcaatgctgattaatcaagatctgagagaaatgtgacgtgtttctgggtttgcttatttttaaaatcttctttcaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgtatgccgattaccacacgcrctttctgtactgcgtayggtaagtggcaagagacaatcattggtagacaccattcttgggtctgacttagggtacatgggcaaaagcttgttttatgagcataacccagaggtgagcaaacaacaagaccttgccctgtgaagtttacatcatctttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgtgccaccacgcccagctaatttttgtattttcagtagagatggggtttcgccatgttggccaggctggtctcaatctcctgacctcaggcgatccgcccacctcggcctcccaaagtgctgggattacaggcgtgagcttccatgcccagctggaagcttacatcttaatggagggagacggttgatgaacacataacatrtgctatcgtgccagctagagattagtgctatgaggagaaaaataaggctggacagagtggggggtgcattgcttaagcgtgragatgtgcacaaagggagaggaaaggacagctgggcacatcacagggatgagagttcccggcagaaccagcagcaagtgcagagccctggcaggaagctctcgtggtgtgtgattgaggagtgcagctgcctctcaccctttacctcgtgcctgggtcgctaacacagtgtcatgtatcacaccccccacaagatttaaagatagaagagcctttggtgycttttgttctgtctcagatatatagcccagtcccctgtagtgccccagctatttgggaggcagcctccctctgaggagttgaggcagtataggtctgcagctccgcagctttagattggagggccctgcagctgcttcccttaggaggcatgtctagctgggcagggtgcgtttataattgggaatagtcaccccaggaagcggtgctttggtgacctgtaggggaatcttaaggcttctcccagtaggggaagagtagcatgatgccggatgggcctactctccctgaatgctagggacctggcctagggacatttgttcagccagttgagcaaccacagtggctatttcttcagcatgggaacagagaaattattcctttttgccyttaaggacactgctcagccgactacttctcaagagctaaggactctcacttctggttctaaagaactttgaccttgagttctgtttgtttgttactggagtaagactttttatgcagttgggctatatttactctgtttcaagaatatcacccctaaaaacatgagttatactcatgaaaacacaatagcttatgctccataccctaaaccggcattctccacagggtagacggtgcagacgagccatgggtaatttgaagaaacaaaaaacatttaatgttacataatttttataattggacaaccatttaatgttacataaattttatagtttactctctgtggcacaagataaaagtcaacaaaaatgatgggggacagaggtgcgtgagccttgtgtttcctcaaagcggacgtggttcccaccagtgtggaagcggtacagggagtggcaggctcctggyggcagggacctgaattggtttgtagttatgcttgtgcgcgtcctcataaccccagtctcgccctagcgctgtcccctttcctctccctccagcttttcctggactttttcacctgagggtcctgcagtaatggcaggtggcctgcccagaaccatgcccttacctgctkcttctccccattttgtttaaaggcagtgacagctaccagttactcaggcttgaggctttatccctgaattctgcctcgccctcgccttcctcatggggttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagctgatggtctgtccgaaaatgctggttcactctccactggccaactgtctgtctgcactgcactgccagttgcctcttgcctgsgccattgcgctaacatctccacttactgttccacctgcttcctgtttctttgccgtttccagaccttccactttgccacgcaagctatctttgtaaaacagctcatgacatttctttcccggaaatctctaattgttccccagtgcctccagaataaaaatccaaactacttaactggcactgagtccttttattttgcatttgtctgtccattactcttcccagactggccccctccttcaggagcccccttggtgggcaccccatgctctaggacaggacatcttttcyttgaattattattattttttttttagagatgggatcttgctatgttgtccaggctggactcaaactcctgggttatagccatccttctgcctcagcttcctgagtacttgagattaggygtgccaccataccyggcatacaggacttgccaaaccaccatcttgctctcattccctctcactgttctctctccctccctttttcctcccacagttgtaattgtgtgagacacccttttgtcctccctctttggtgaaatccccctcatcctcggagctctgggtctgtacagtctcttcctcttggctataattttgccttttagtgtttgctccctcctctgtgcctgcrtagcgccatgcaccatgtgccattgatggcactgggctgtatttgcctgcctcttgcccagtgattctgagctcccaaaggtgagtgctgagctgtattactcaactgagaaacctcagggcccatgttgtccttagaatacagccagcctcatcaaatgttcactgtgtaaatgtttaggtccctgatgtcttgaggcccttctaactgggaggtgttttctaaactttttggcagggctcctgcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcatyagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttycccagaataatgcaattgcaaacctctgcattgttgttcagcttgaaggtcatgggcctccgaagttcatttatagaccctctagggagctcatggacctcaggtaagagcctctgtgatagagaaaagatagtatgtgaggtatgtggaaaaagaaacaaagttgatggattttttttcttctaagccagtcagttgagtatttggacactcttacagtgtgaagagcagctggtttgctctttcctggttcctgtagcactttagaaccaattgtacttgacaaaatgaggtgattattcatgtgacacctttggcatcttaagccaaattacaggctcaacaggttttgcccaaccagttaagaatccagataggttttcttctcctcacttggtggcaggggagaagttgcaatctgtatttaaaatttactgtgcatcagagaggaaaatgccatttctaattgttggagaagggatggtgtcagcaactgactagccataggggaaacaattgactttgatctctgacttgttcatttcaccaaaataaattccagatggataaaagattgaaatgtaagaactgggccaggcgtggtggctcacgcctgtaatcccagcactttcggaggccgaggcgggtggatcacaaggtcaggagatcgagaccatcctggctaacacagtgaaaccctatctctactaaaaatattctttaaaaaattagctgggtgtggtggcaggtgcctgtggtcccagctactcgggaggctgaggcaggagagtggtgtgaacccgggaggcagagcttgcagtgagccaagatcaagtcactgcactccagcctgggcgacagagtgagactccatctcaaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggaggcagaggcgagcacatyacttgagctaggagtttgagaccagcctgagcaacatggagaaaccccgtctctgcaaaaaatacaaaaattagctgggcatggtggtgcatgcttgtagtcccagctactcgggaggctgaggtgggaggatcacttgagcccaggaggttgaggctgcagtaagcgagattgcaccacattccagcctgggtgacagagcgagaccttgccagaaaaaaaaaaaaactggacaaaaatattagtatgcatggcagtcagcattttcttaataaataaagatctcatctcagcctggccaaaatgtgaaaccctgtctctactgaaaatacaaaaaawattagccacacgtggtggtgtgtgcctgtagtcccagctactcgggagactgaggcaggagaatcacttgaatcctggaggtggagtttgcagtgagccaagatcattccattgcactccagcctgggcgacaagagcaagactccgtcttaaaaaaaaaaaaaaaaagttgtgaaaaaaagatcaacaacctgaaagaaaagtgggtgaggtcatgtgaaagataacaaaagaagaaatacaaaaaaaaaaggtttttattttatttttcagagacagagtcttgctctgttgtccaggctggagtgcggtggtgtgatctcggctcactgcaacccctgcctcccaggttcgagcaattcttctgcctccacctcctgagtagctgggattacaggcatgtatcaccaggcccagctaatttcttgtatttttagtagagacacggttttgccttgttgcccagactggtcttgaactcctgacctaaggtgatccacccaccttggcctcccaaagtgctgggatcataggcatgagccaccacgcccagcctcagtaaatattttcttgactaaagtaatgaaaagggaggccaaggcaggaggattgcttgagcctgagaagtcaaggcttcagtaaaccatgattgtgccactgcactccagccagggcaacagagtgagatcctgtctctaaaaaagaagaaaaaaaggaatgaaaaatagttaagcttctttggaaggcagtttgggagaatttatcaaaattggaaatatacatagtttttgattcattgattatgctttaagaattgattctagccaggtgcagtggctcatgcctataatcccagcactttgggagggcaaagcaggaggattgcttgagcccagtagttcaagtccagcctgggcaacatgacaaaatcccatctctacataaatacaaaaattagccagcaatggtggtgcacacctttagtcccagctactgggaggctgaggcaggaggattaattgagttcgggtggtcaaggccacaaaaagccgcgattgcaccactgtacttcagcctgggcaacagaacaagacactgtccccctgtcaggcccccaccccaaaaaaagaaaaaagatttatttctacaagtatgtgttttacacattaaaatatttataggctatttatagtaactttgtaatagaaaaaattgcaaaactactcatcagttgggggggattggctaaagtataccagaaaatactgtaggaaaagaataaggaaactctttatggagcagtctccaagatacaaaattttaaaatgtaatgtgcagaatagtattttactgtttgtgtggttaagagggaaaggggaagaatctgtgtgtttgcttgtgtgtgtgyggagtggctctggaaagattcgcagatggtcacagtatggggaggagaactaagacaatgaaacagatgttggagaaggagagaattttcgataaacacttttctgttctgtttgaaattgttaacatgcatgtactgtatcctttaaaaaaaaaaaaaaaaagagttactcttcctgaatgataaccatgcctacctcagataaaaaatcctttttattcattaactgaagtacataaagactatttcagcaaactcttgtttaattcttagagcccagagatacagtccatagctccagtgagaaatctgtgttgtgatttttcccctggtatgtgtctaattttctgcatgcttgtaatctgctttttgatgtcacatttttcctttctagatcaaaactacaataacgccactgcccttgtgattaccttccctgtcaataattactataatgatacagagaagctccagagggcccaggcctgggaaaaagagtgagtcactcatgggtgtgagcagactgtccttgcattgtgggaagctagacacttgcrgcaagcacttaaacttcattttctaaattaaccaatggcagatctgagttacgtagttttgttcacttggtactaatgatgctaagaagaaactgtaaacacatttacctttgagcaggtgctttaaacagctctccctccacaggaatgcaaaagtgtgcaaaaaaaggttccttgcattgtttttacttatttcatttattttttgagactgggttcacttttgcccaggctggggtgcagtgactgaatctcagctcactgcagcctcaacctcctaggctcaagtgatcctcccacctcagcctcctgagtagctgagactacacgtgcatgccatcacacccagctaatttttgtatttgtttgtagaaacagggttttgccatggtgcccaggctggtcttgacctactaacctcaggtgattcaccctcctcggcctcccaaagtgccgggattacaggtgtgagccactgcacccagccacctgcattgttttctaacagcaaaacttgggagcatgctgaatgtatttaataaggaatgaatacaatagaatattgtgctgtcataaaagacagtgaagtaaatggtccatgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctctaaaaaaaagaaaaaagaraatttaaaaagaaaaaaaagcgtacaattcagtagctttactatattcacgtgtatgtgcagccatcaccacagtcaattttaggaacattttcattactccacaataaaactctgtaccctttaactaacaccctccatcttttcatcctcctatccacagccctaggcaaccactaaaatactgtctctggagattttcctattctggacttttatgtgcatagaataatatgtggacttttttgtctggctatcattgaacataatattctcaaggttcattcatgttgtggcatgtatcagtactccattccttttcattccattgtatggatataccacattgtgtgcatttatcaactgacaaacacttgggctgtttccattttggctattatgaataatgctgctatgaacacttgagtacaagttcttgtggatgtgagttttcatttcttttgggtacatacctagtagtagaattgctgagtcatagggtaagtccaccttgaatagtttgaagaactgccagactgttttccaaagtggctatagcgctttacgtcaccaccagcagtccatgaaacttccaattcgttcgcatcctcgtcagcactttttattatctgactttgtgattctagctatcttcatgggtgtgaagtggtatctcattgtggttttgatttagtagactgaatgcatttcttttttttttttttttttttttttttttgagacagagtcttgctgtgtcatccaggctggagtgcagtggcatgatctcagctcgctgcagcctctgccttccaggttcaagtgattctcgtgcctcagcctcccaagtagctgggattacaggcacctkccaccacgcctggctaatttttgtatttttagtagagacgggctttcaccatgttggccaggctagtctcgaactcttgacctcaggtgatctgccagcctcagcctcccaaagtgctggaattacaggcataagccaytgagcccagccctaaacttactttaattcagcatgtatggaaccttagctgtaatctgatagtctccagtgtggaagaccctaatgcagtggctgggcatggtgcctgtcatcccagcacttagggatgtggaggcaggaggaatgccttgaggccaggagtttgagaccagcttgcacaacatggcaaagaccccatctctacaaaaaatttttaaaattagccaggcatggggatacgtctctgtagtaccagctactcaagaggctaaggcaggaggatcccttaagctgaggagttcgaggctgcagtgagctgtaatagtgccactgtactccagccgaggcaacagagagagactctatttcaaaacaggaacaaaagcaaacaaaggatcctaatgcaggataaaggttaagaaaacatggcctttgagccgggcacagtggctcacgcctgtaatcccagcgctttggggaggctgaggcaggtggatcacttgaggtcaggagtttgagactagcctggccaacatggtgaaaccctgtctctactaaaaataccaaaattagccgggcctggtggcgcacgcctggagtcccagctactcaggaggctggggcaggagaagcactcaaacccgggaggtggagcttggagtgagctgagattgcgccattgcacttcagcctgggcgacagagcgagaatcagtctcaaaaccaaaaaaaagaaaacgtggcctttgtatcgtgaaagttagggagaagtttcttacttagctgtcagttagtttaactaaaaatataacattttgcttaccttttaggtttattaattttgtgaaaaactacaagaatcccaatctgaccatttccttcactgytgaaygaagtattgaagatgaactaaatcgtgaaagtgacagtgatgtcttcaccgttgtaattagctatgccatcakgtttctatatatttccctagccttggggcacatsaaaagctgtcgcaggcttctggtaagccggggggggggtggtgtatgttctagaggttaacagcagtgcacagtgtaacgtcatatttttgcctctttattcttattccatyatgtttaaaactgccataaattcccccatgttktaattgtatgtaacgtttctgttgcctacatctattttcttcattccaactttttgktttatcttaaagtttatttcacataatccagttttttcttatttgtccagtccatcacctaagaatgcaaactcataacatgtgttgccsgagcagacctagaaatgtttacaagtcctctctgaaacacagaattgtacattcaactctaggtttaatacagccctgtaaagtaaaaaggaggaccttttagtaacaagtgggacagacaaccctgtaactaattggtgattgtgtctgtcgcctctctcaggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaayatctycattctggtgcaggcctaccaggtatacttccatattctcacagggctcagcatctgttcaagtttcagggactgtgaatggctcctgggctccgcattcgtgagtgtgacctgtgagggtgttttgtttcctttccctgtgtggctcatcggtcgtcttgacttgctgtggacatcttaggaccaagaatttcacccctctttttggttgttgaaatagtagatataaagtaagaattgtgttttaaattgtatctttaaatagtgtcttttaatagtatcttttcattttaaatagtatcatgtgtacaagaagggctaacacacttttggaaaagattttgggtacgactgctgttaaaatgatgttcagcatagtatagaatgttagattcattttgcccaaaggtgccactaaaaaggcaaaaggtcaacacgtgtcccgctgctgtagaaggtggtctcagtcgtcctgtagacccgacgtgggyggagactcagtgcacgtgagagtgatgttcactggtccagtcccctgccgcctgtgttccgagtgttttcctgataatgtggctggctcagctttccctttagtttctcacttggtacctagctctgtagtgcagaaatactctgagaacattggagtcccccaccgaagtttatatgcttagaagacactgctaatcgtctactaatcatttatttttacccttgagttaacacaaggcagcaagaaatggcgttgttattgagaaattttaatgtcgcataatttttttttttttttttaagagagatgaacgtcttcaaggggaaaccctggatcagcagcygggcagggtcctaggagaagtggctcccagtatgttcctgtcatccttttctgagactgtagcatttttyttaggtaattatgctttcaatcctaccagtcctgtagtctgctgagcctggagaaagaaggagctggctacctgaacatgtccctttgtgttgcttcctttttttttttttcttttttttttttttctctgagacggagtctcactctgccacccaggctggagtgcagtggtgcaatctcggctcactgcagcctccgcctcccgggttcaagcgattttcctgcctcagcctcccaaatagctgggattaaaggcacgtaccaccatgcccagttaattttttgcatttttaatagagatggggtttcaccatgttggccaggctggtctcgaactcctgacctcaggtgatgtacctgcctcggcctcccaaagtgctgagattacaggcgtgagcccccgtgcccagcccgtgttgtctcctttttttaagctttgttctgcactgggaaagtatcactggaccacagaaaaattggcagcagtaacttaggtgtgattttgcaagtggcttccttctcatttaactgtcaggacagcattgatgttggggttcagggtgaaagagacctagagttcgtcttgccactttccccttttagtagccactgggaatgttgatagttgaaaatggcatccttgagtagccactgaatccttctccacatgacactctaagcagcagctcccaaatccacaggcactcgcttacaaratgtttgccgttgttttcaaaggcagtctttctcttctgtgcacacaactcattggggaagcagccttgttaatgaccagaagctcttgactcaccacattacaaggagccagaataagctggaacaaagtcagcacttctgtgtttctttcacatagagaatcatcaaatagacccactagtggggckgtctgccccatgtctgaagtgtagtaagagcaaagtgactctgtccactataggggaggctggactggaatcactcagtccaaagaagaccatccacgggccacaaactgcaatgcctacatggctgggaggtcagcttaatcagggccattgtaaggtcattgtaggtggtagtctttcaccacagatacactgctagcttgttattcttcatctccacaaagccatgtgcttttgaaacctgtagccctgtagttccttttgacaaacacaggtgcagaaaaaaaaaaaaaaaagaaaaaactttctttttttcactactattataagaaaaccagtgcaagtgtgatgataatagcagcagagactgtgcctcaaggttggagtgaccttgggacagtaggagtgagtagggattgtggcaccccaactgcacgtgtcctatctaaaaagacagttatgtgtgtggccaacccagtgctacaaggtctgtgttgttgttgttgtttttcttccaagcaaagctgtgaatctagatttttgtgtaaaatgccattgttaaatattggcaacttataaaaaaaagttttttaatcttaagatgggttgatacagtgtgggctaaacaggaaccatctgattcatgggctgccagtttgcagtttccaagtcttaccctcatgcctttgatcctcactcgattgtagattacctcttaactaaactgggaggctagtagtgttgatgtaataaatggaaaatactgtccatttcttacagtgaagcacagaaagtactataagaaatggcctgtattagtggttctcaaattttaatgtgtgtgaatttgctgtgaacctgagtatagtagaattggggttgaattcctgtcataactaggatggggcttcccaaatggtctggtgctgagtgtgctttgaaaagcactggcttatcacctcctgtcccacttctggtgtaatgtccagccgcagcatgccttctcatgcgtttggcctgtgctggctccttgtatctgtacatgcacatgaacataagacctgcagagagcccccggctgtaaacagaagtgacgcagagcccttctctccccgacaggagcattgtccgtgatgccagccgtgcacaccttctctctctttgcgggattggcagtcttcattgactttcttctgcmgattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctsagagagctgtttgtttcgcttcttcaaaaactcctrttctccacttctgctaaaggactggatgagaccaattgtggtatgcgcttatctgtggtttttctctttcctctcactgaaacagattatcacatgccttctaagaagccagacagcctgggaaggagattcttaaagctgttaaaatgtatctaaaaaaaaagcaaaagcaaatgtggaacagtagataaaatgtttttccygtgagcttttatcagtccatataaacaagagttttmagttttttattttgaaatagtttcagattcacagaaagttgcaaagaaacttttatttttcctcttaataatgaggaaatagaagccaagagaggtgaagtggtttgccccaagtcactcagcccgtaagtggcagagtcaggatttgcacccaggaatttggactcctggtgctgtggtctcacccactgccctgtactccctattagcctgtcatttaagcttttccattttaaaaaatcctgctttttgtgtgtgcttaagattttatttctggtcgtaagcttatttactaagcagtctctgtcttatgattcatttgttgttccagatagcaatatttgtgggtgttctgtcattcagcatcgcagtcctgaacaaagtagatrttggattggatcagtctctttcgatgccagatgtaagatgacttccttttttttttttttttaacttctttagctgatgatgaatacatttttcaaaacatgcacgtaggtgtttcaagcaagtgcctgcttctaactgcaaatggtgacagggtttccagggttaggagaactgtcgcagtgcactgctggtgtgggctgtctggcattctgactgagcccctctgggcacagctgcagaacacgaataactagtcttatgaggttactttatgagatgctctcctgaytgtgggkctagcaggaggagcaccctggggccctggggggaagactggtggtgttaggaatcatgagtccagctggaggcatctcagccaggaacctcctggcaccctcttattctccrtgatcctcgccttgcttagttactatcagagtgttcacactctctcctattcttttatctttctttcaggactcctacatggtggwttatttcaaatccatcagtcagtacctgcatgcgggtccrcctrtgtactttgtcctggaggaagggcacgactacacttcttccaaggggcagaacatggtgtgcggcrgcatgggctgcaacaatgattccctggtgcagcagatatttaacgcggcgcmgctggacaaytagtcagtaccaccttgtctygtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccraataggcttcgccccctcgtcctggatcgacgattatttcractggrtgaagccacagtygtcttrctgtcgagtggacartatcactgaccagttctgcaatgcttcaggtaccttctcctttaccaaatctttccygttttgctgaaaaattttcaaattatcatttaaaaatcatttgcatcgtgcctcagtttatacctatttgtatatcaaagctgggtctccctgtgtcatcattcctttcctcagtcattcattctgaaattgtcatgttgttcctggctcagacagccaccctcggggctgcaagctgaacaaggtccacatgttcggagtgtggtttccacataaggtttctcatcctgttctaactccagcgattgcctctcaggattggtatctggccttagcttctcagaggagggcttttctttatcactttaccytgtggttttgtaggagcgtcgaggttgccctggaattttcttaataaaaacatagaagccccgggctctgaccagtcaaggccatacttgaaggaggagatctacttcagggcagaaaatgatgcatagtatgcctaagatgaaaatggtatttcagattcattaaactgtgaaagtgacatgtggctgaagcttttagataaggggaaagattatccctcactagtraggaaagtaatcgatagagaagaaagtaatrcccctcactgtcagtattttaaaatgttttacaaaaaatctggagacctattcttctaacagtcctccctgcatgtctccgccagtggttgaccctgcctgcgttygctgcaggcctctgactccggaargcaaacagaggcctcagkggggagacttcakgagattcctgcccatgttcctttcggataaccctaaccccaagtgtggcaaagggtaagtgctgctgccattgcagataagcatccactgcaactttaatttgcagtagaaaactaggagaggactgggctaagacagttgcatgggaacgtctcttctccgccccaccctgtcctggtcctttggtggaagcaggaaaaccgaaaacacctttttaagaaaatgcctcatagtgttcaactgattctgtcttagcgtgggcattcacatctcatgctctctctgtgtcctggccccctgggcatgagaatgaacgcagattcctgtgcacattccaagcggggctgagggagaggacggcctgctggtaatccaggcctgaaggaacttggcctrttcacttgtactgatggcagctggggcgtgatcttagctttagtaacattatcccacattaaggttgcgattcttttagcctcgtcatgctccttgccagcccatccatgtatagggttatgggctatctcactcccccatccagccaggcagccagttacccacggaagccagatatatggcccaaaaatagtgatgatgaccggaagtctctggccttgatttggaagctttkggaggtggaagatgagtatccccatgtatgttaggtaaaccctgaacttaggtttttcataagaacatacatctgaccagagtcatatcagtgaatcatttatatcatgcatgtgctttgagacctattcgaggtatcatgggatgactcctcctaaaagttaagtagaaatgaatcttgcagcttgatttactcactgactggatgctttggcctacgtaaaataagttgaagtagattcagtttttctgaaggcagtagccaccgttcctggggagcctccagggtgccagcgtcatgccaggcactccctgacattattccatttctcatcacgcagcctatgagtaggtggtgktatacccatttacagaagaggagactggggctcagaggtggtcattttgctcggggttacatgaccagtaagtggcagggctgaggttgttcccagggcccttgccctttcctgcttcctattacacaacaggactgagtaaaccctgtacmtttgattatacatgaaaccaggtggagaaacagcagctatgtaccaaagaacccagagcaatcgagaaaagcccatctggccaggcgaagtggctcacacctgtaatcccagtacttttggaggccgaggtgggcggatcacctgagatcacctcaggagttcaagactagccaggccaacatggcaaaaccctgtctctactaaaaaaatacaaaagttagttgagcgtggtggcaggtgcctgtaatcccagctattcgggaggctgaggcagggagaattgcttgaacccgggaggtggaggttgcagtgagccgagatcacgccactgcactccagcctgggctacagagcaagactctgtctcaaaataaaaaaaaaaagaagccagtctgggagagaacaagctaaacctttgsygttcccttatctgggggccttcttcatccctgaaatgtacagctgggtctgacctctgagtccagggtcaggtgattttgcttagcctcaagtgctcagattctgctgatattttgcaagacctggactctcttgacacccaggattctttcctcaggggacatgctgcctatagttctgcagttaacatcctccttggccatggcaccagggtcggagycaygtacttcatgacctaccacaccgtgctgcagacctctgctgactttattgacrctctgaagaaagcccgacttayagccagtaatgtcaccgaaaccatgggcattaacggcagtgcctaccgagtatttccttacaggtaaagcctgccctttttcaatggggtttacccagcaaagggcctacactgggtgggagtggggagggttcccttggcaagatgctgattttcaggttgggttctggcccctgctccattctgagcacagggcagtatatcaaaggaaatgggtgctgggcaaaggagttcagaatctaaagtctctgtgaaggcctgagggctagagacgcaaaacttgatctctgcgccactgcacagctgcaagagacacacactggaaaatggcttaaggcagggggcgcttggagagcaggcggctcagagcagggcccggcccacattcttggccaacaatgaaccagaatccctaactgctggttatttgggatgctgcctgtatgtagactttttatattgttaggggttttttttcccaggaagaaaagtattatgtatgaactactgaatttagaaactgtagaaaggtaggagaaacaagtgatttatttttcctgcctccccatgatctcgcttaaagcaggaaggcctggatttgtttggaagaagttaagagccggttagctctggcagaaaataaatgaaagcatgttttcctcaggccttgcacggaccccgctgagcctgaggtagtgtctcaggatagatcaggattctttgtttttttgtgttttttcagaatgctgtggaatgctctctgtaaatgtctataaaatagcatagattgggcttataaacagaaactttatcaaaaatatacattttgcatcactgctgggcccttctctgggtggtcagtggccatgagaggtcaagtgagttgctttcggtgagtcttgtagacagccagcaaggttttctgcaagggatgtttcccaaaggagtytgaccacttggcagtggtgacaggatgaacacgcagtgttygggagtgagagcgagctttaatgagrcctcccctctcccctccagtgtgttttatgtcttctrcgaacagtacctgaccatcattgacgacactatcttcaacctcggtgtgtccctgggcgcgatatttctggtgaccatgktcctcctgggctgtgagctctggtctgcagtcatcatgtgtgccaccatcgccatggtcttggtcaacatgtttggagttaygtrgctctggggcatcagtctgaaygctgtatccttggtcarcctggtgatggtgagtcctcatacagtctcagtttgtccctagctcctgtttcacttgggggaattggctgtcttagattccatgtaaaccctaaagatggagtaagataccaagtctggcgcttgctcttggcacacatggagaggcaggatgagtgctggaggagtgctggatggtggtgggacagggcatagagggagcgagcattgagttggacatctgggagcataggcacattacaggcaatttctgttcaattttttctcttgtcccattccttgcggctatactagtatacctgatggtgcctctgaccatggaaatgtgatttcctggcctagttctgggctagtctgcctgtaatttgttattctttagagaytgcacaagcctgtagcctgatgacagcaggatgttcactttttacttagaaaattgcaccccrccccaggagctctccgaccagtgccttttgcctcctatgtggttatcaggtacttttaatcattaaagatgagagcactrgagaaggtattcatggaaaatagaacagtgtatccgtactctcagatatgagccctgcttcagataggggagcactgaggtccaagaaaagaagttgtgacaatgcgccagctcggtgcgggtggggtgaccttaacgggttccagcaatttctcctggtcaacacaaacgtgccacagaaaaccaggcttttggctgtgtgtagagagggccccaraaagttcctggtacagtaagattggtgtgatggaggccttgtaagtccaatgggatgcttggcctcctctagcacccagggtgccctgggtaattagcacccatcctcagaacggggtggctgcctagggtcttcaacaggaagagagccatcctaaaggaagtgctttatttcagagctgtggcatctccgtggagttctgcagccacataaccagagcgttcacggtgagcrtgaaaggcagccgcgtggagcgcgcggaagaggcacttgcccacatgggcagctccgtgagtaccctgagcagggccacgccggcagagtcgcaccacaaagtaatcctcctcagtgrctgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcycatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatcctygtaaggaagtgtttttgttcaattacaggttggtaaaagtggtttctaacacagtatctcttcttttaggtgttcrgtggaatcacacttasaaaatttggagggattgtggtgktsgcttttgccaaatctcaaattttccagatattctacttcaggatgtatttggccatggtcttactggragccactcayggattaatatttctycctgtcttactcagttacataggtaagagttctcatcttaaaagggtggcacaatrgaaggacattactgaaagggaattctatcctgaggcattcttttcaagtatttgaactcatactaatggtcatttgataatgataaatgatactgagtaaaaaaatttcttctaaaagaaaaaacccatccaggggattcatgatggtgcagactactttattaggaagttgtcgatgttttttctggaggcctgatctgtctgcttcacaaaggcctggagccagtccttgaatggatctgagtgtcagcaggcagggcagctcctccctgccactgagatgaaggagtccatctggcagccagctctcacaccagcagtgctgcagaacagctttttatgtccctcatggatttcccgtttcttagcaaagtgcttgctgcctttcttcatctcgagactgtccttgatccttttacttctatggccacttcaccttgcacaaaaatgacccacggttgaaagarcaatactgatttgcttcatttatagctttgtcactaaattgaagcactgaagtagaagattaagaaaatgaggggctttttatcatctccgggggatagaaagtagttctattacaatctaatatactagttccttttaagaaaaaaaaaaaaaaaaaagagatgagcactttggaaggctgagacaggagaatcgtttgagaccagcctaggcaacatagtgaggcctccatctctacaaaaataaaattagccaggtgaagtggtgtgcgtctgcagtcccacctacttgttaggctgaggcaggaagcttgcttgagcccagaagggtgggcttaggatgcagtgagtcgtgttcataccactgcactgcagcctgaggaagaaagcaaagagcccatctccaaaagagagggagagagatgtggtctcactctgttgtccaggctggtctcaagcaattctcctgcctcagtcttccaaagtgggattacaggcgtgagccactatgcccagccaactagctccctttctcctgcagaaataagaaaaagtctctctctctcatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagytgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattctatctaacctgtccttatggtaactaaatgccgtcttacattgagctagaaatagacctagaagtttcattagacagccctgatccttccctatcctaaagatgatgtcttaggttgtataactatttggagatgagaatgatcaaccagggccaggtgcggtggctcaaacctgtaatcccagcactttgggaggctgaggcaggcggatcatgaggtcaggagtttgagaccagcctggacaatatagtaaaaccccatctctactaaaaatacaaaaatcagccgggtgtggtggcacgcacctgtagtcccaactactcaggaggctgaggcagaagaatcgcttgaacccagcggaggttgcagtgaaccgagatcacaccactgcactccagcctgggcaacggagcgagactctgtctcaaaaaaaaaatgagaatgatcaaccaatgtatacttcataaaactgaaaccttaataagccccagaccctttaaaacccttagccaccatttgccgtcttattcctggctttaagagatattccaagatctgctataagagatgggctgtgcctgatctgggtcctaaatgtgtcttgactcaaaacacacctcctcggtgagttccagagcataattcagattctgtcagtatactgaattcactctactacaaataatgggccaagggctaggtgggctgttatcaaattgtgttgtttacaaaaatgctaacccagggtcctcgcccaccagctgccagtgccctctgctactctttgaggctatggttaccccaagtcttttcattgcattctcacctggtgtgaaattggggctccctcgcaaacgctggtttcgctgttcaaaaaagcggaatattgtatagaaaagcatgttgtcttcagtctgctttgcagcatctaaaaattttcgtgcagaaatgttgtcatggccaccaatgccccggataaaccttaaggcagctaacacttggtgtttggaaaggagaacttctactatttcatcatttgctgttgaaagtcgctagcagtaagggagagaagtccaggtcagtgcaaacaacaggaacagagttagtttccatagtctaaaacctcacacatcagagttaccttcagcatgtccagagatagctgatgagcaggaggatagaaactctctagggataacagcagacaagcctgaaagacatttttagacccacttcagttggaaagataacggttaaaattttccatttttaaccacaatggaagtaaaaatctggcaatgcataccaaaggtttggagtcgctgaggacgtggtactgcaggaactgatgcagcatataaaagaggttgtgctggacaagggttttgataacaagttcatgtagrtaatgctgaggacaaaagtaaaaagtgaaagaacacttccaaatcattcagctacaacagactagaggctccccaaggactggctattctaaccaacacagtaaaagtctgtcattacaagaagtggtttcgtcatgcaggtaaagaccccaacttgaccttacacttcccattccaactaataatgtcaggagtcactcagcattctgagtcagggaggcagacctgtcttagcatatgagtcatcttctaagacagtgactgtgttttttttttaaattccttctgttttaacttgggcccagatgatttgaaggtacctgtactgcaatctgaaactggttaagagaacgaatgtattccatcagcacggctatcacaaatttatgaggcatctcctagggagaaaaaaatgtggtcttacaaataccaacgaggtgcaaaagaggctgcatataactctctatccaacccccaccttgtttccatcttaaaatggcccagtgttcatctttcactggttttgcacacatcgctccagaaccacccgtcaacaattatgctttaggcctcagcattagaagccaaactaccagctctagggcctcacccaaggaaactccagtgattctaatcacttcaagtgactctaatcacatgaagtctcctcgttttcagcaacttccttgttttgagcattctcagtccagaagaggcggaaagctgcggcccaccttcttttccacnaaggctgacaggacatgggtgtacacatctgactggtccagcaccgcctgggtccgcaccggcctcttgaggagcgggctgcttcggytctgccctgcttccacygcctgaaagaaaaaaaccacaaactatgatcttcggcatcttagaggaagggtgctgtttacagttcatccacaaggactgaattcttcgatgtggacccaggatatgagcggaaaacactttctctacttagatacaactttttcctgtgcgcatgcctgtaatcccagctactcaggaggctgaggcaggagaatcccttgaacccaggaggcagaggttgcggtgagccaagatctcaccattgcactccagcctgggcaataagaacaaaactccgtctcaaaaaaaaaaaagcagttcagatccgtgcagattatgcaatagctgtggggtgtagcctgagaacttgcatttccaagaaactccagatgctgctcatgtggctggtcagtggcccacactgctgagtcatgacggtttatggagcccagcagaccgtgtgggacggcacagaaactgccatttgggatcagacctactgattcccacagcccagaacacccacagcaatagagtccaaaaggactcagccatccctcacgtctggcagcgtaggaatggacactgtcccagcaactggccctcttcagtgcctgtctcagacctcttacccttccatgaacagctaaaggggagtggagttctggggcttttgttggtttaaaaccattttcagcctaggactaatcagatcctggaattgaaataattcattctccttgtcctaaacttttcttctggcttcagaagatatgatgtacaagtaatacagcgggaattggtggcgataagccatggttattaccttgactacaaacacgcctgctaagtgctaacactgaatcgtcactatctcaacaggattctttcccaaaagggaagaaaggtgtggcaaatataaatatttctaatttaattttctaagtcctcactctggcataacagaaaaatatacaaaatattgcaaagcagagactgatttttctcatctataacagtagaccaaggatctacaggcaagatcaaacacagatgggaaaaacaaaaacagtgaaggtatgaagtgagatgcagccgccagctcgtgggatgcagggaccctgaatttactactcctccactatcccccactactgccaccttgccctatggcaggcggcaaatctcagcgaccttattctaatatataggaaacaattttgcatcataattacttagaaaatacccgggagggggtgggggaggaggaccctttgtcatactccatgtaactcaccatcgcataactctgstcggcatccaggtactttttatactcatggttgagtttatcaaaaacagtggctatcacgggcagcgatgctctgtctgactcacttaacactggaaaggcacaatgttcacacacggatcaaaccaacttcatgtcagcttcagaatttccacacgttgctatgataaaaactaatctcaaaaggttaccaatgcaaaagtacctttaaaggacactctaagaaatacaatactttaaagacctgacagctagatgtcattcgcaacccctttctggttacggttaaaaaaaaaaaaaaaaaaaaaagctatagcaggccaggctcagtggcacatgcctataatcccagcactttgggtaggccgaggcagaaggatcacttaacgctgggagtttgagaccagcctgggcaacaaggcaagaccccatctataccaaaacaaaaacaaacaccaacagcacatattggtaggggattattattattatttttttttggatacagggtcttgctctgtcgcccaggctggaggtacactgacacaaacggctcgctgcagcctcgtcctcccgggctcaaggaatcctccctcggcagcctctggagtagctggggccacaggtgtataccaccaaactcagctaattttttttttttttttttttttttttgtagagacagggttttgccatgttgtcgtccaggctggtctcgaactcctaggctcaggcaatcctcctgcttcagcctcccagagtgctgggattataagcatgagccaccatgcctggcctcagtaggggattcttaaagaagacacatatgcagtgagtggcttggattttgaaagaggtgtgtgtgaaggccaggggtggtggcccactcccctcctgtgtgcccactttcattcagaaccatcccatttattgttcttttctaccagtatctctacaaatcatctttccatttagcagcctttcctagggggtcacatagccacccctcacataaagaatgaggctgtgggtcacagacaagacacaacaatgtagcccacatcccgataaaaagtgttgggcagcacaggcctcacactggaatcagagcaagggggaaggattcaacttactctgtgaacagacagacaggatgaccatcttgcattcctttctctggaggagaaagtccatgagtcttcctttgtctggtaagagatttactatgggctcaagtttcacttggaggttccagaggtaacctggattttaagaggcagcaaataaaacagtatgatgcaaaccgtaacaaaagcccaaaagtggttcccctaaacatctgcggggcgggtggcaggtggtgataaaaagccgcaaagtacagtcagtgtagcttttccttcctaaccaaagcagagctgagccattcaggagcaattcaggagcgtgtctaccacaggaggatgacagcccaaccaccgcacacctggctgactcttttccaagtaacctctgcattcaggggcacatcaaaggtgtagctcctagtccttcattccaaacggggacttccctagacctagcccctcttttaacgtttaaaatagaaaaagatgtcaacacgtggcatcaacttcagtcctgtgctttggtttctcctacaacagctcattagtttaaaaggtaactccagaggctctcaatggaacatcataactcatccattcatcgacccataaatgtactgatcacccacactgccagcatctggtgtggcctttcccaattgggatgccacaggagaatgaagtgccacataaaaaatcatctgggtgacccccttttcagttggcccaaggcaggtacagagcagctgtacaggaaaacaccagcgagatgcacaggagagaaatgacttcattacatacatacagtggatgtcacatgaggctatgggttacagacaaggcacaacaatgcattacatacagtggatgcctacagcatcagggctaattctctcctcaagagttcttaggaattccagaggaaaggcaggaaaatacacagaggattaaagagtaacataggagattctctaataaccagcctggcgaggtattagagacacaggggcaacatggcaagaccctgtctctacaaaaaaaaaattataggccggctgtggtggctcacacctgtaatcccagcactttgggaggctgaggtgggcagatcacgaggtcaggagatcgagaccatcctggccaacatggtgaaaccccgtatctactaaaaatacaaaaattagctgggtgtggtggcgcatgcctgtaatcccagctactggggaggctgaggcaggagaatcgcttaaacccaggagt

SEQ ID NO: 12380 - DNA, 13410 bp, Homo sapiens
tctttctttctttctttctttctttctttctttctttctttctgtctgtctttctctctctttctttctttttctttctctctctctctctttcatctctctctctctttcagagactgagtcttgttctgttgctcaggttggagtgctgtggcacaatcttggctcactactacctctgcctcctcggttcaagcgattcttctacctcagcctcccaagtagctgggattataggtgtgcaccaccacatcctgttaattttttgtgtttttagtagagataaggtttcgccatgttggccaagctggttttgaactcctgacctcaagtgatccactcaccttggcctcccaaagtgctaggattacaggcatgaaccaccacgcctggctagacagacacttttctttttttttttttttttgagacaaagtcttgctgtcaccaggctggagtgcagtggcacaatctcagctcattgcaacctctgcatccatggttcaagcgattctcctgcctcagcctcccgagtagctgggactacaggcgcatgccaccatgcccagctaatttttgtatttgtagtagagacggggtttcaccatgttggccaggatggtctcaatctcttgacctcatgatccacccgcctcagcctcccaaagtgctgggattacaggcgtgatccactgcgcccggccaacagacacttttcaatagacctttctaatttgcttatcagcttttctgagctttgccttaagaataaggcctcattattaaaccacatattgcagtgttcactgccatgaattcaccgagttaggctgaattctggtaatgtcctgctatatatccaacacatacctagcatacaaattatttctatctatagagaaaaatattatctttgggccattcataactctccacttagaaatcgggaggctgagtcaagagaattgtttgaacctgggaggcggaggttgcagggacccgagatcgcgccgttgcactccaagagttccagggcaaagctctggttgacagggtgagactccgtctcaaaaagaaactacttagaaatgataaggcctcattgttaaactacatattctactgatcactgccatgaattcacccagttagggtgaattctggtgatgccctactatacacccaacacagacttataatacaaattctttctatctacagagaaaaatattatctttaggttattcatacctctttcacttagaaacagtagtttcattcttagactcaactgcttctctggtaaatctcattctgtcatagcaattcacccaatcttaaggcatacactgacttttaacattatttagagtaaccaacctaagggaggtgacatccaagtcatgaaatcatagagtaacagaatcttggaacacaaggaacctctgggatgacctggttgtacctcctatccagcagaaggagtctaatccctagagctcaggagcttgttcatctggccccacctaaacacatctactcacaagaagctctttcccttagaggccaggctgtttctttggaaattgattttaatatctagaaactcttccttatatttgctctcttataggccttagtcacccatccaccactcctcagctggaagcagccaagaataacatcttattctaccagtgacaatccttcaaattcttatgggctatacaccatgttccacttaggcatctaattctctttctactatttggcataatttcttgccctgccagtattctggcaaatgcttctaatgttctctaatttgtcaatatccctcttaaaacatttcatctagacttgaagccattaactgagatgtggtctactatgactatttgtatatatatacttcttttttgtgcaatagcatttatacaatccacaaatgagttaacttctgggggcaactgtgtcaaatgcttggctcaaattaagctcatgaccaattacatataaaaccagaacatgagaacataagccagattctctaagtagaagtaaagcatacatctccagaagtaaagcatcttaaaataatcatcttcctgtagatgtttaagggatggaattttatgataatcacccccccactgacctgctgcatagtttgtcaactcaacatcaacaagctcatcatcagattttgcaaaagacctcttgtttatcccagcctaagtgaatgttcttttgcattttaatcactttctgcacaatgttggtatagtgtcaaggcccaaagtaggcattagttacttgctgactaagccattagataaatgaatgacgagttcccactctctcccatcctgtctttaataatgttgattgtttttcatcagtgtatttctccccacatcacccttaagagctatagttctccattagggttctgggcagtgataatattgttgttcctgccattaaatgattctgttactttagaaaaactcctaagctgcctaagacccctgtttctccatatgaacaatactgtcattttatttattatttaaacaaagacgtatagtacttgttgcagaccagctacagttctaggcacttaacaaatataaaatcatttaatcctcaggaaaaccagactgaggcacaggaaagttaactaatttaataaagattatatagctagcaagtgatgaagctgggattcgaactaggcagtctgacttttctatgtgtgttaaccactaggctatgctacctatccacatgctctgagagcataatgtttagataagtaggaaggtcaacgatcacactccttgcatcataagtgtatatgttagtacatcaaaaactgcttgattttccattagttcctcaaatagtagcttctccttccagtcctcatattttttaaagttactaaccaaaggacaaatcactcaaaacatggcattttgaacatagagtggatgccttgagttgatttgaattccttccagtcacaactgttggaattatttacctgaaacgttaaggaccatgaaagccagttgacctattgccagaacaagagcaaatcaaaaaagtgctataccaggcaccaggaatctgagggaaaaggaaaatgtacttcctcagaaaaacatcaaagtataggctattccagcttagtgctggcccagctgaagacaggaacagaaaggtactcagatgtttgcatgcagtttaccatagtgtaaatagtgacttgtactctcacaaataagaaaatttggaggacttaatccaaaatgtccagtataatgaaaatttttttcaaaataattacagccagatcacaaaagctataaaggaataaactcctcaaggacatggagtaataaggaaaaatggaaaagcaggttggaaggcaatgcagtcacagaagcagctctcctgagtggcattttttactccaaatttagattcaaactaaattcattagtccttcagctgagtaagaaacacctgagcactgcatagagccaggggaacatttccatttaacaatggacctcatggaaagcaagatccttacagtgtagggctaggggctgcggcaaactaatctgtaagtttagaattttgctctggaaaatttactattggaaggatcttgtggtgattagtgctaatcaacaagaaggcactgattgctttttgaatggccaaaagtcaaatttcatatgaacgaagcaagcattggacacagcaatagaacatctgcataactgttattgatgaaatgataacccaagattctgcgggaaatctattgggaatacaaatatgaattcggattctcacctttggctaactgaaatattcttcaggtgtattagatgaagggaaggaagaaaaagcagttaataattgcaaagcatgattctaagcaaacaatgcaggatatatatgtgcgtgtgtgtgtgtatacacaaatacacaccccatatatttactatatagataatatatattaatacatgtaatacattatataatgatatataaatatataatatattatgttatagatataatataatagtatataatatataattatatcttatatattataatatatagtatattaatgtaataacatatattaatataatattttattattgacatataatataatatgttatttacatattatttatacacacattattaattatattagtagtatatatatattatttatatacacacacaaatatacacacatatatttctccccactcttaccccatttaggaggtgagacttaaattactgtgagactaactcttaacatgcctttctgaaagacaaaaggaatacctgtccccactccgttaagtgtccctaggaacttcacagaaagaaacctttatgcttctaaaaatcagtaaacagctagaaaataaagcaacagcccaggtaaagtccaaacttgagaaacacagcttatgcttttgttctggcaccagcacctccatttcccagttgtctgggtgatataggtgtcacgggaattgaggccaagtgtcctgggactctgggtctaaggagtctgctctcctcttcgcactaccccgggtctgggagactggctggtcctgctgtcaggggaatgaaggttctgagaaggtgcctgaatcctggtcagaggaagaggtcttgtgaggcactaagacaaggggcttggacatgactggcagagacaaactgtaggagcacagcaaggagaaagcaggtcctctcccaccacaaggacatctccaggataggctgaggcagacagtagactgttctgtcaaagtggaatattccagaagtgaaaatgtgaagcctagatctccttatctataattgtgaataattatactgtctcttgtatcccaatctgcatgatccaccccaccactacacttcctcctttatcaactatttgtatacataaaaatataagaaataatttacttttctcacttcccattaggctttcctaagttccctggacccacctattccagtgaacagtgagagaatgcagtttgttagcagtaaataataaaacagacaataagggtcttgtctcaagtttccaaactgtctctctttcccagaacaagagaagcttctttctacaatagtattatctagaactatcttttaatttgtcataaagtcataattaaacataactccattttagagactttaaaaattcattttgaaatttaccttgcctgacatttacaggcggatttcaaaaaaattgttcttcgatcttctgggaagagctgaagcacgcgctcttggctcggcgcagcccgctgcaatccgtggaggaatgtgccgccgagcaaccatcatgcctgggcagttacaggaaggcttcagctgcctggtcaccaaccgattcgaccagttatttgacaactaatcggaccccttcgaggtgctgaaggcaggagagaacaagaaaaaagaagctggcgggggcggcgtctctggggccaagagcggcagctcaggctgcgacccagaccaactccaaggcggcaggcaaatagctagctgcgcaaggagtcccagaaagacagcaagaacccgctgccctccagcgttggcgtggttgacaggaaagaggagacgcagccgtccatggtgcttaagaaagaaggaataagggtcattgttctcgtgccagtaggagctgaggtcctggtcccccagcctcctgctgcagagccagtgaactctggtcgggcctctcagctgcgcacgtaggcaatactcatcttggccctgggaggaaactcaagaagaagcttttgaaacataaagcttagatggggtttgacctgtgctgggcagctcccagctataggcgttcccctgctgagcagagaagatgactgcagaattgagagaagccatggccctaggcccatgccgcccagtgaaggtgaaaaaggaggaggaggaagaagaaaacttcccagatcaggcatccagccaacaagtgcactctgagaacatcaaagtctgggccccaggggagtttcgtcagacaggccttgatggatcagaagaggaagaaaaggtgctgaaaccaagaaccttcagttactggttccaaaaactgagatacgtgaggaagctgaaaacccccgcatcatattaggaagaatccagaaagctgatccttaaggacctgagttaagagaggcttgtgaaaaagaaaacatgttaaagaggcagagaataaggagggaaaggaaagatttcagataagtsataktgaatgactgtcacttacctgaaagcttcaaagaagaggaagaccagaaatgtargaaatctgtgggaaaatacagccttaattctgacactgttaacaatccgaaaacccagcttgggcgaaagtcttttacattgtagcatgtgtgggaaaggatttagtcagagtgcaaacctcgttgtgcatcagagaatccacaccggggagaaaccttttgaatgtcatgagtgtgggaaggccttcattcagagtgcaaagctcgatgtgcatcagagaatccacactggacagaaaccttatgtttgctcaaaatgtgggaaagccttcaatcagagttcaaatctgactgtatatcaaaaaaacctctccttagaaaaaacctttaggcgtagtaaatgtgagaaagcctttagttatagctcacaacttgctcggcaccagaaactccacattacagaaaaatgctgtaaatgtaatgagtgtcggaaaacatttactgggagctcaaaccatattgtccaccagaggatccacactggggagaagccctctgcctgtaacgaytctggcaaagcctttaygcagattgcaaatcttattgtacatcagcgaagccatactggtgagaagccatatgagtgtgagtttgggaaaacctttagttgtttttcacaccttattatgtaccagataattcacactgcagagaaaccttatgactgcagtgaatgtgggcaagccttcagtcagctctcttgcctttttgtccaccagaraattcacagtggagatcttccttttgtgtgtaatgaatgtgggaaggccttcacatgtagctcatacctacttattcatcagagaatccataatggagaaaaaccttacatgtgtaatgagtgtgggaaggccttcagacagaggttgagcctcacggtgcaccagagaacccacactggggagaagccctatgaatataagaagtgtggtgcagctttcatttccaactcacacctcatgcgacaccacagaacccatcttgttgaacaacaagtaaggaagaggaagacttccagcattggtcataaccttctgcctcccaaatgagacacctctttgctgttttcttcttcctttataaagatgaggcctatgtccttaaaagttacagttttcaggaatgcagcacaaaacacaagataaacatttcagcagttaatttaaagaaaacagaaagtaagcacctgaaggcaacgactttgttttaactgtaccttaagtggtcatgttttctgaaatggaatgtagctttcttaggaatgggtcatacaaagtaatgattgtatttggggaaaggtcttttttgcttaattttgtttttaaaaactctgatgattgcttgagcaataggcaggttatctgcctggttgaattctggttgaaccgtgtattctagtatttctggttaagtggtgactaggtaaggaaaccacttggggtagcaattcaacaattcacttatgaatgtttataagctttccattttctaagtaattttttaaaagctagtcaaaagaaaaaaccttaactgtctactgtaccaaaaatggacagaaacaggaaatggcctttttccttactgtctataccccctgaaccttgatattgtagatattgtaaagctctggagacctctgttgagtctgttctgaccattccctagtgtgcatggccaagccctcaaggattgatggacaccacacgccagctatagtcatttgttaagattgacaactcctcctccacacaactcaagctcccaattcccattgcattccatttgggtaagatgcaaccaacagcccccttcctggatagaggaatcaaagaataaagcttgcctagaggaaaaataaaaaacacaaaaagaagaaggaataagacaagttggaagaagacctgctcaacaacttcacggtgaagggaaaataactgatagaagaccagaaaggagaccaccttgtgaacgaagacttgaaaagccacttgatgaaaggggtgaaggaggcgaattttcagttgatagactgattattgaccgacctattcaaggtcatggtggtcttggaagaggtcgagagggcagtggacgtgaaatgggccaaggagatggatttgattctcgtggcaaacgtgaatttgataggtatagtggaagtgatagatcttttttttcacattacagtggcctgaagcacgaggacctgtaacgtggaggtagcagatctcacaactggggaattgtcaaagatgaattaacagagtcccccaaatacattcagaaacaaatatcttataattgcagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggactgggcaaaagtagaaacctcttcaatccctttatacccttaacctaactttctcttactggtgggtaataactgaaaataaagatttattttcatgcaaaaaaaaaatctgttcttcaagatcatcacattcagtataagaaaatcaaattctttctgtccaaatgtactgttctggctttgtcaacttgacagcagcctctgcgcccagctattctacttgtcaactcttgactcagatacttgttccaaaccatgggacccctctgcttttcattaaagattattataactaacttagacaaaaggaaccggactttgtcacacagcaccagaaatcccagcactttacagaataatcattctttatctttaagatgttcacagagttgctcaattgacaataggaaacaaactttttctcaaaagagaatctcttccttttttatttcttcatgatttgccccaaaataaatatattccagtgcaccatttaaacagtttaattcatccatttgtgttactatgccctagttacttctaacctggaaagagggtcacattcccttcctttctttgtagtggagaagtcagaagatactcataatgatagacattagtaagtgcatcctgtgtgtgtgcacacacagccattcataatttagattattagttctgccagggactctagggatgtcctagggttaaagatggcctagttaaactctcttcaatctctttatacccttaacaaaactaagataacatggcagagacttccttggttcttttccttcttccagtcactcagcacacacctgcagaatggattcatgaccctcctacttttcctctgctccacacttgcctgtttcttctctctttcctcttgacttggtccactctctttctgagcttccttctttcccataatctaccatcttccagagagctcattcacaccgtgcatccatgcattgcatgtatgtgtttctgatggcatgaccccactgccaattctccaaaatttcaaaagtaaaataaacaaacttacaactttctgcttcagataaagcaaaargacactttcatttagaacacaaagagagaaaactaatttttgagtcagaaagtaagctcccattcaccatgggagcttcgcattgagagcagttcatgtacatcgtaaatgttcaataaacacatccacttgcagatagctgaggagctctgagtcagcagcaggtagtaagtagataatgaaagcaaactaaattagaagtcagaagactgagcatctagtaccagctctgactgaatcaagttatgtgactctgagcactttttttttttttttttggtaatatcaacaaggtaacactaaattattccttttttttttttttttttttttttttggaaacggagtctcgctctgtcgcccaggctggagtgcagtggcgggatctcggctcactgcaagctccgcctctcgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggcccactaaattatttctaaggtattttccgttttgaaaatccaatggtgataaaacatgaattacagctaaagattaaaaggccttcaaagaggtttatagtccaaccactaccactccctttatttcatatttccagaaagatgactatttgtcccatttgaaaattttccaggaaaacatttgattttcccattgtcatctgcaygcaaattttagtacaaaaaaatagttctcagatttaacccaaaatccatgtctatgtttatactgctgctaatcaattcaggacttaaatatctaattataaaatttcacaaccctcataatcttgggatgtaattttattttcaatgcaagtattaaaagatatggccaacaaggcataaaaacattttccctgaagtcgtatcattgactaaatcatggagcttgtstattcagcttctctctcaatatacatttatagcaggacatgattagttttcacctaagaaaactctgcttattaaattatatttcattcaccaggactccttatttatctcagtaatatttaatggaaaagtaaataaaacactattacatagatgyttagagagatgacagtaatcttattctaaattaaataaagaaaggttaagtaaatattacaatcttttagtatgaaccttaaaataataaatctacctccttattttttatagcttattctggaaatatttatcaatgtaatactgaaactaacttatcattaattattttctgtttttttttatttttcaaaagcttaagttacattgtatgctagttcccattcagatcttaatataattactaattcatttttaacacatcctgattttccatttcaataatgcattttaatgcatagctatatatccccattataaaactatgcaataggaagtgctgacattacaaccttgtattataatttttgaatttgaggacctccctagatacacatatccacacacacacacaaaagcacacgcacacacacattttgttttcaaatatctaaaacaaaggctcactcttaaccataataaaccagaaacaaaaaaagaaaattgctttcaataatgagtaaccttatgtttatataaggtaattatttatataatctcattatctatttgaaaacagacctgtggtgaaaaaagcaatagttcatttacatattatgacaaagtggtttaaatctatatttgaattaaggaaattactcaaagctaaagtttttgttttccccttgcaactctttttgtgtagaaaagtaaataaggaatcttaaacaagtactattaaattttgcttagcttcattttaatgaggaatgacttcatcattcctatggccatgctgaaaaattaaacttatctctgactcacagagagtctgtgctgagaaacatgaaaatcaatctaatgacagaaacagagctatgacctgtatcagatggacaagagaaaaccaacatttcaaataaatcctcaacagagtaacttccactttcatcgttaaattcggtgtctatatgtgggttggaaatgtatctgggtgaacattagatttaatactcatttttaagaccctgcttctgaaacctgtcctggaatagtttcatgataacttgcttatgcagcagctttggcctctgggtaccatgtttctgacaggacaggagactgcataccagagggagaacattcacaatctctttggaatctgttacttggaggggtctgccagaggcaaagtcttaaagaaagtgatgctcattccctgtgtttttccattctccttacctagtccctaccagtctgtcctgctagaagctggcttccctaaagctagatgttcaggcctcagtgtcgctggattaaatcttcatgcagtggactttttcttttttcatgtccccttccataaatactaagagacattctgtgctggaggtagaatcaacagcaaaacacaactggctgccaaagtgctgacagactattgggaggaagataaacatttatgaaacagccatacagataaacacagaattctcctactggggactgccaccaaggagacattcatggtgctatgaaagcacatgataggggtatatgatccagttccagggttcagggaaggcctccccaaagaaatgacaatcaggctgacagtcatgatgtaaggggctcccaatgaaaagcaaatgctgagcttgggaacctgaaagaagatcagtgtggccactgccaaaaaggaggattatgataggaagctggaaaaaggaaggcaggtgtcagaccttgtgactttttggggaaatgttaaagatttattctaagagccttggagaacattaatgaatattacgtggataatgaatgaaataatgaggttagagttcagaaaaaaggtccactgtggtaaacagatagggtttagggttgaggagggcaaagtacagccagcctgcctccttccttccctccactattacaaggggcagctgtgtcctcctttgctaggacccacatttcactcagtagaactgctcttataaatcacctctgtccctttttcttccttattggggaagaagaaaaatgtccatcctaggaatgaaagcatatcccagatattcagagacaaggagtcttcaatttttcatctgcaaagcatgattaatggtgggatgttgggcagctaaggactctaagatacctttgggaatatgggatcctctttgagcctctcaaatgatattacattaggtcctagaagaccatgtg

SEQ ID NO: 12381 - DNA, 32346 bp, Homo sapiens
gcatgtgcctgtagtcccagctactcgggaggctgaggcagaagaatcgcttgaaccgggaggccgaggttgcaatgagctgagatagcaccactgcactccagcctgggtgacagagcaagactcagtcttaaaaaaaaaaaaaaaaaaagaaaaagaaatattccataatacaaaataatatgactgggtgcagtggctcatgcctgtaatcccaacactttgggaggccgaggtgggcagatcacaaggtcaggagttcgagaccagcctggccaacgtgatgaaaccctgtctctgctaaaaatacaaaaattagctgggcatggtggcatgagcctgtaatcctagctactcaggaggctgagtcaggagaatcgcttgagcctgggaggcagaggttgcagtgagctgagatcgtgccactgcactcgagcctggacaacagagcgagagtctgtctcaataaataaatatgtacatacatacatacacatataaaataagaaaatagagccagaaaaccctcactgaccaggctgcagttaaagagggtcaaatagagaaagacagccagccagatacaaggcattaacacacatgcacatacaggcacacacacaagcatacatacatacacgcacatgcatacacacacatatacatacagacgcacacacgcatacacacaggcacacacacatacacacacacatacacacgtgtccatacacacacaaaactcttccacagccatctttaggtgaaattttgaagatgaaagtttttcttccatgtttggacccatctgccctttcagaaaccgcaaccttattgctctactgcttcctaaatctgcttttggagggaaatctgatcatttgaaatatttcctgtgactgaaagtcaaagtgtggtcttcttaggaatttacatttctgtgtcatctttgatggggcaagaagttgcattgtttctggcttaggaatttcaggcagtgggtgtttgacagggacagcaacagtccccagcacatgtggaattacacatataggtaatgtttctaccagtcccagaggtttctctaaggtgaggaacatagtctgtggcctgccccatccccccatcccttgagtggaacttgcccactctcacctctttttttttttttttttttttttttgagacaagatctcgctctgtaacccaggctggagtgcagtggcaccatctcagctcactgcagcctccacctcccgggctcaagtgatcctcccacttcagtgtcccaagtagctgggactacaggcatgcgccaccacatctggctaatttttgtatttttggtagagacagggtttcaccgtgttggccaggccggtcttgaactcctgacctcaggtgatcttcccgcctcagcctcccaaagtgctgtgattataggtgggagccatcacgcctgggcaactcttatctcttgagacagtagttgggaaagaacaggtctttggttatatgaccagtgagactgtcatgatcctgcagctcaccatggtttcctcttgtttcccccactctaggggtggggcagaaggccttaactctgaaaaagctgaaacagctgcttcttcagagtgccggaagttggtagcagagtgccctgcttctgtggacaatggtttttatctccaggtttgtcttcatcttctctggatccttggcctccttgaacagttctgggtcataaaaggctgagagtgggcagagagttattttactagattagtgagatgctgtgcccaacctagtcccatccataatcaggggctgccgctggcccttcctctcactcagtcttcctccacccttgcggccccttcttactcctctggaatagagtatagctgcttctggttctgttctaaggacaggaactcctgggacagccactcccgcattaggtcaaaaacatttcctgtkgattttattagtttccttccaaacaatgcatttatggaagaagaagagcttttgcaggcatgcatttgcacaggcagccaacctcctccagtcacacacagacacacacacacctccacacccacacgcacacactttcttcccatccgcccacaaagcatcagtcacatttagaatttgcacaaatgcacaccctccctcatacatcacaatgcacaccctctcatccacctacatgtctcttccacaaaatcacacctgctcacatacccttagaagcacattcctgtactgtgcccagagagagaaaggtgggggagataagcaaggagaatgggttagaagggctcaggaggtcaaacctctgtaggagctgaaaagtcagaagaccaggaccccccactcctctctgccctttttttttctttctttcttttttttttgagatggagtcatgctctgtcgcccaggctggagtgcaatggcgcaatctcggctcactgcaacctccgtctcccaggttcaagtggttctcctgcctcagcctcctcagtaagtagctgggattacaggcagccgccaccacatccagctaatttttgtatttttagtagagatgaggtttcaccatgttggccaggctggtatcgaactcctgacctcatgatccgcctgcctaggcctcccaaagtgctgggattacaggtgtgagtcacttgttcccggcctcctctttggccctgtaagtagaaatactacggctgggcaaggtggctcatgcctgtaatcccagcactttgggaggcgaaggttgcagtgagccgagatcacgccattgcactccagcctgggtgacaaagcgggactccgtctcaaaaaaaaaaaaaaaaaaaagaaatactatgaattgagagagatttagaattaggggtaggggaagcaggaactcagggccccctgtcccacacagaaagtgtgctgcctctgtgacagtgatgtatctcaggctggtggctgaggtgggaagtttgtcaaggctgtaagtggcatccatcacatgtccgagaagcccattttgaccagtagaaaaggatggcctttagggtgggattccctatcagctcaggaaatggtgcggagggaatgaagagagataaggaagtaaaaggctgggttgggctctgggtccaacatcctctagaatgaatcttactaatgtcagctggaatcaagaggaggaggctccccttcactggaaacttgaagtccccctcagagaaaaggcgggagagagggcttggaaaagtgacaagtgcccaagagcagcccaggcaattctgccttcggccccagactattgtctgcctgccctgactcagcccaaactcagaaactgtggattctggaaagtaacgagacttttcctttgggaaagggtcctgaagctgacccacagtgctcaagaaaattggcagagaggccaggcacagtggctcacacctgtaatcccagtattttgggatgccgaggtgggcggattacctaaggtcaggagtttgagaccagcctggccaacatggtgaaaccctgtctgtactaataatacaaaaatgagccgaacatggtggtgggcacctgtaatcccagctactcatgaggctgtggcaggagaatcgcttgaacccatgaggtggaggttgcagtcagccaagatcgcaccattgcactccagcctggacgacaagcgtgaaacttcatctaaaaaaaaaaaagaagaagaagaagaagaaagagaggaagaggaagaagcagagaagaataggaggaggaggaggggaaggggaagtggaaggggaaggggaagagagggagaggaagaagaagaagaagaagaaagaaggaagaagaaggaagaaggaagaagaacataattgccagagagctcagtgaaacagagacagaggagacggaagtgagccacacactctgtgtcctcgcctcaccaggaaactactaaagttcctggggaagcaaagtagaatttcataagaacaaaatggatggagaggagaaaacctatggtggctgtgaaggccctgatgccacgtatgtcaaattgatatcatctgatggccatgaatttattgtaaaaagagaacatgcattaacatcaggcacgataaaagccatgttgagtggcccaggcgttttatgggtttggcttttaaatttaggtctttggtcttaagttaatttttgtttatgctgtgaggtcagtttgctgagaacgaaaccaatgaggtcaattttagagagataccttcacatgtgctatcgaaagtatgcatgtattttacctacaaggttcgctacactaacagctccatcgagattcctgaattcccaattgcacctgaaattgtactagaactgctgatggctgcgaacttcctagattgttaaataaaataaattataataaactgttaactcttttcagtatgtaatacctgtagatcagttagtaactttttcatatatagcatgttgcctgtatgcagtttaactatataaagttcattgcaaagcagattatcttgtttttttcatagcaatcaaagttgaaatttgtttgctacatcaacaaattaagaacattttcacaaactgagaaataaacaaatatgccaattaaaaaaaaaaaaagaaagaaacagagacagagatatctggcccctgccatccatgtcttgacagtgcctcatgagtctctcctcctgctgccgcctgggggcgcccccagctgggtctcaggctgctgccagcactgctgttgttatcattagggtaattaataaacaagcactgctggggccaagtggaagaagaggcaggcccctgctgctcaggagaatccctgaaaagatccagtgagcctgcggcaaccggagctgagtggctggtccctcctctctacccaggacctctggaaggggtgtggggtgggcttccccctggagggaagggcaaggggaggagcacacttggtaggcttggtttggaaccagctctgcatgtgcctaacaggatgtctgtgggcaaggccaccctcgtgattactggttgtggggcaggctctgaagcaattattcattcatttaacaggcatctgcctatttatttatggaaagcctactgtgtgcaaggtggtctactaataatagctaatgtttgactggacagtgtgacgacacagccaactttcacaccaggtcctgggaaaaggggtagaagcaggggaagcaaccaggaaaaatgacagcccaaaaagatacgggcaattaggctttggcctgtgtagtgtagtggtggggatatatattaggtaaaacctggggattaccaagatcttgggaaactcaggacccaagttggaaaacatacggcaattggggctggagaaaatgggcatttttcaggtgggagggacttggagataaaggcatggcaataggacatgaatatggggattttgggtgaatggctcaatgaaagggaggcacgaagggatgctagccgatcctgttgggggagccccgggtcacggcagtttcggggagccagatggatgggagtgtctaggggttgaggtgctctaagtcctgagagggggatgctggattctgggatcagagtccgaacaagagttggggtgtggtgggggctgacagcggggttttgagggaaggctctggagggctgggttagaaaagatgccggagcgggtttagggaaaggaggggcgtggccggggagcccatcctggaggccaagccggatcctcaggtttggccagggggcggctggggccggcgtgccggcggggcgccggcggggccgcgggggtttgcggcgctggctgggattcgcgctccgagccagtcgccggggctccgcgggggggcggtgcgagctcgggctgcgggcgggccgggaggaggcggcggctccgagaagaacatgaatcagcggcggcgacggcggcgacggcagtggaaggagcgcggtggcgcgggagcggccccggggaccccgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtaggggctggcacgggaggcggcgggaagcggggggctgcggaggggcgcggccgggggtcggagcccggggcgggcctggcgggctggagtcggggtgggggtccggagccgaaggccgaggctcggagccgggacagggcacgctgcggagtgctcgccgccagatctccggccgggcccccacccccaactttctggcgctcggggctcttctggcggggtggaagagaagggagcggggtgtgggctgtgtggtcagcggggagtgtttgggactgcattttcccgcctcgatgttcccagctgttagctccctccttcccagtactggggaccccattctgcctgccccgcacgcgaaggtccgcctcggaaaccacacgggccggggctgggcacccaaaggccacyctgataccatttaggtacacaggggctgtgagggtgcccagtcacaaaaaacaaatgggcacactcgagttcctgtgccctcagagcttcctgaaagcagaaccttggagaggatgggctggtgccaggttgctggtctttgggaggggttagtcttgtgttcccacatagccactgaggcatttgctggtgacaagagcgttccatgcagcacggtgctctccaagttcccaccccgcacctcggggactgatgggcatatagggagcgggaggctggcccccatcctgtgactggtcctgagagggtgaagggagcagggaagagccacaggccaggacagcggccacccgctggcatcttctcttgagacagcattccttgccatatcagcctctcagggaagggaagggaaacggggtgacgagtatttacaagccgaaaggtgcggacctgatgctcagggagcccacgactttgcctagagtcacacagcaaagggtgagaagaagcagggctggatttcagttatgtggatacttgacctgcccctctctctgcttaaaaacatgccaggaggccaggagaggtgcgtgtatgtgtgtgtgtgtgtgtgtgtgtgtgtgtgtgtgtgygygcgcgcgcgcgcgctcgcacgcaagttccaaagagtggcccctgttaatgtggcagtggctcaggggtcttaggctccctgctcagggccccagccctcccttctgcctcccaccttcctagcactcgcccctgcccacattcaggtattaatagagtggatggctgccaggaaggctgccatgtgtttgatctgacgtggttttgcagccatatgttctccacttcaggggagcaccccctcctttccttcttcagccctgctccatttggtaaggttgggtgcagagggtgctggcagcaattcagggtctgggctgacaccttgggtggagagctggcagcctgttgcactagttgggtgcagcagtcattcctagagcagtgcctgccccagtagggtaactcccatcgtttcagcccagcctgccttccttttgctgtctgggctcagaaggaggacatggggaagaggtgcttagagccggagggaacttggagagcttgccatgccccttcccttcgcccaggtccagcgaccttcccttccacactgtcctacctctgcttccttgactttggctgagaaagagccctctgtctgacacagaagctaccttctagaagagaatgggaactgtttacagagacagagtccctctcaaggctgacacatgttccttcccacccctcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcaggtgcaggcctgtgggggaaggtgtgggctgccagccagggggcaggctatgctctttccttggggattgggagctggggccctctcctgatgcccagaggtctgtggtttttttatttggctacctgtgggaccttccagaagtgggggcaggctgaactcatcaagtttgcccagcagagctgccgcccttgccctcggaagcaagcctcgtatcctgtttccacagcctgaagtcagtggagcgctctgacgccggccggtactggtgccaggtggaggatgggggtgaaaccgagatctcccagccagtgtggctcacggtagaaggtgaggaggcagagccatatgggcgtgttggcctggagcacgtgctgtctgctggtgactatacctctgcagcggagaactcagtagaagctgggctgccccactgctctgtggggcctggttgtccaggctgtaggcccactccagatgtcggaagaccctaccagttggagttgggtatctgagaaccaagggaccaactgggatccacaacctgtggggtgcagtctgtttccgttgcttgagcaacaagcttcaagcatccatctgggactggaccctgttctgccaagtggcctggccagcagggggaggggaggaaggctctgcagctgcgggagctcagagctgttcagcccaggaaaacaaagtgactaagaaagtaacaaagggccctgaatgggagctggggcctggcagcagaactctgctaaagctcycacccactcccctgagttttatgcccctctcccagctctccacccccagtctcctctcttactgcaagaagagctgtccaaatctgccatgcctaaggggghagcatggaagatgtgtctaaggtgccaggcatggtggcgtgtgcctgtagtcccagctactccggaggctaaggccagaggatcacttgagcccccaggagttccaggccagcctgggcaacatagagagacctccccrcgaccaatctcaaaaaaaaaaaaaaaaaaaaaaaaattcctaaggagcctgaaaaagagaagcaccgcctacctctcaagctagatgcctgttctgctgttgacctaatcataaggggcctgtgggaaccttctgcgtggaggacttcagatgtaaacagacttgtgatttgtacagtaggaagccaagaggtggcagggctcactcctcactccccttctctcctaggtgtgccatttttcacagtggagccaaaagatctggcagtgccacccaatgcccctttccaactgtcttgtgaggctgtgggtccccctgaacctgttaccattgtctggtggagaggaactacgaagatcgggggaccygctccctctccatctgttttaaatgtaacaggtgagcagcctcagaagggggctgggagtggagaaggagctgggtcctggagggcactgaagctggcagtttcagccactgagcttgcggttgtgagygtccagagcaagccccagtgtctggggacgtgagctgcaccattactaagctcattagtcaggtgtgctaggctggctgggtgggctgattagtggtgatcctgctgtgtgtgcttaaggagggtgtggggccacctttggttcacagcagtccaggccatgcacagctggccctcagagatgaattgtatgagaccaggggcacccatcccccacccctcccaaggaaaggagccagaaaccagcccacgcagaactagggaggagtatctggcagacactgagaagacaagactctcaggctgcagagaggggagaggagggagagagaaggggtagggggaggttagcacaaagatacagggcctcctcccctaatggcgctttccgggaaacctccacacgttttctcaaacaactgtgtctgtccatacctctgcacagtcacacctgcacacccacctgggccccaagtttcttgggcacataccctcacatgcttgtaaggcttgcttatttgtgaaacaaaggcttgcttatttgtttctggttgaggcttgaattgggcaaaaaagatgggagtctgagcttggtctcatgtgctggaaggtgccagggaaatgggcgctgagctaggttctccagcaatttgaatcttgacaagaggtggactatgagacctcttggaagcaagtgcaggtcctgttcaggaggygctgagktggagcagattagagaggaggttgggttcacttccttccaggtgtgcgtggttgggaccctcaggcaggcagcctgataataagcactcactgaactcctactccacacyacactgtgctaggcaccacaggggacagagggaatacaaaggaaatagaagctaaagaactgagtataactggggagacaagacaygtgcataaagagctgagaactactgcaaggcagagagtctgcaaataacaaccccaagggggcacagagcmaacagaagggctcactctggtatgcgcaataaaagagtgaccagaaaaggggggcaatttgtgctgtgtgtgggagatgggatggaggtgggagggtggtataacgtttctcaagggcttatttagcatgccgtgcacttgacacacattacctgattctcacaattctcccatttgagagatgagaaaacagagccctctccaggctcaccagactctagtgtccctgttcatttcaccgtacctcactgcccagccccttcctttggcaggagggatttaaggatgttcagaccagagcctgagtattcccctttcccagtcccgcactgagtggggttgctgcttggggagctgactgaggttttctggmcccaggggtgacccagagcaccatgttttcctgtgaagctcacaacctaaaaggcctggcctcttctcgcacagccactgttcaccttcaaggtaggagggctggcagggaggaagggtggatgaggccaggggcattcccagcgagctgtccagcagttagaaycrttctgtgttccagctccccttgtggtcctgctgggatctagggagcaaggggttaattggcatagctcccattcctagtgggagcacctgagaccctgcgtggctgagatgagaatagaatcctgacgtcacagcagatttcccatcacgaagcagagtccttgggagggagggaaggagggagggaggcagcaggagatggtcaaggcccatgcccagccttgtttctgcccctccctttgaggggatgggggtggggaaaacagcctagtaccggatggaggagaccagagggctggtgtacagagagagggggagggagagggtgtctgcaggagccaggctgtggctgcaggggcagctgcctgtctctcccttgtatctcccaagcctgaggtgctgcccccacataccctctcatcttattcctcagttacacagggccttcgtggcagggagaggcaacctctctccacagcccaggcactctcccaggtgtgagcagctgtgccctactggttgcttatttgtgtactrctgtgatcctgggagtgctgagtagccgtctttaggttggggatgccctggaccctcagagagactcaaggcttgactcccatgcctcctgctgcctctgctcatatccctactgggcactgattctgagtccccrtccacagcactgcctgcagcccccttcaacatcaccgtgacaaagctttccagcagcaacgctagtgtggcctggatgccaggtgcygatggccgagctctgctacagtcctgtacagttcaggtaggctctccgggccgggccatgctcgttctggctgcatggccagcactttgttgacagggatatcacactcactagccagctcctgggggcttggtctgcagctcttttcaggctctgctccttagcaggaagaacacaggccactgtctcttatcatggggtgctctggcaactaagtgactttgcagattggctcaaactcatgcattcataaggttggaaagcagatcactagaacagatttggggtacctggaaggtttttctttctttctttttttttttgagacagggtctcactgttggccaggctggagtgcagtggtgccatctcggctcactgcaacctccacctcctgggttcaagtgattctcctgcctcagcctccccagcagctaggattaggattacagtcatgcaccaccacgcccagctaactttttttttttttttttgtatttttagtagagactagtagttcaccatattagccagcctgatctcaaactcctgacttcaagtgatctacctgcctcagcctcccaaagtgctggtattacaggcatgaaccagcacacccagacgagtttttcttacttaggtgaaagctcaaacctttgctgatactcaccctatcatgctccaccttaccccccaacccccactcaagccaaagagaacaagatgaccagaaggggccctaagccttggagagtggaaaaactgtgtaaggtgatactaaaaacaagaggcaatgcaggcttgctcattttcatccgtttactcaaaggccatttaatgagtacctttcaaaactgttctgggcagttcccctgggcaggaggggcccctgctctgggctccaccatttagagaaccctactgaggttgggcacagtggcttatgcctgtaatcccagcactttgggaggtggagacgggaggattgcttgagcctgggggttcaagaccagcctgggcaacatggcaaaaccctttctctacaaaaaatacaaaaattatccaggcacagtggcatgcgcctgtacttctaactattcaggaggctagagtgggaggatgacttgagcctgagaagtcaagcctgcggtgagccgagatcatgccactgcactccagcctgagtgagtgacagggcaagatcctgtctctattaaaaaaaaaaaaaaaaaaaaaaaaaaagaggatcctactctggccctcctttggccacacccctttccccggggcaaagagcctacagggccaagaggatatgcccatccagatggcaaggaccccctcactgccacactatactatagctattcaggatctcttgccctaatggttctgagtctgcttctggggtctgtgtgggccttttccctgttccatcttcccaaggatggaccgcagtgtgatatgaccacctctaagcccaaggggcagccattcgtgagggggatgggaatggagcttggatatgcagtcagcattgtccacgcctgtgcacatgaggcccctcatggtgcagaccttggcttcaggccagctcttccagtgcctcctcattctgactcgggactccagggatttggagagttacaaatgcaaacctgatctcccaggttgttttgaaggtttattggtcaaaatattaagagagaaactatttaatagtttgttagctgatttataatgtttaaatatttagacatatagtacgtggatctctttgtactcttgccctgggcccccaaaatgtaagatgaagggctggttcatagtgccctaggctcccagttttctctgagcttcagaagctctagaactttggagtggcatgtaaacaggcacagtaagtggtaagtataccctaagagtttcgtaccaagtacaaaaggacaagagttttctggagtggttgagaaaggctttcaccaagaaagtgatatttgcactgagtcttaaaggatgagtaggcctttgctaggaagagcaggtcattccaagtgaaaggaacagcatttgcaaaggtatgaagatgtggaaccctgtgtattattggggtgggggcagatgggagggcgtgggttgcaagtgtttgctgatagaggaagcaytcattcaagcacccataactatacccatyccatcttccatctctcacaggctctcccctacatcattagttttctgcttttctgtaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctaggtaagggatgcatagagcagagcgggtgggcagggctggagccgggaagggggccgtgttggctggagttctgaatggtgctggtagagatggaggttcaggcatcattcggcaaacatttactgcatataactacataccaccttgtaagtagttcttgtaggtggaacagataagcaaactggaaaagatcagataatgtggttgataaagagtgtccccaggtggttaaggaaaccccccctaaaaaggtctgaaggataaagatctgaaggatctgggatctgaacgataaagaagaagccatgtaaatatctgggggaaaatcactgccggargaaggcacagcaagtgcaaagaccctatgacaggaacttgcttggcaattgcaaagaggctggcatagctgtgagaggggagtggtaaggggtgaggcagaaaggcagtaaccatggtgatgaagagcaacactgccgagctggggtgctgcctgtcctgcccattgcttacccctcccccagcacagtgggtgagagcagtcagagctgggaggtgaacccttccccagtttgtgcctctcagagctgtttagttcttgggagttgattccaaaggtctgcatggaattatgatggtgggaagggcaggggtcttagcaatcttctctctttggctrcagccccagccagcgctccccaaaacctccatgccatccgcacagattcaggcctcatcttggagtgggaagaagtgawccccgaggcccctttggaaggccccctgggaccctacaaactgtcctgggttcaagacaatggaacccaggtaagacagaaccctcccctctctccactctcctggagtataagccttcagggttctaaggcctttaagaatttcaaaatgattgtctttggtgggcctgggtctcccgcagccccagggaatcctttcctcctcacsctcctctgcaagctccacttctcaaaggattatgtctcctgttagggttgcatcctgtgtgcactttgtaaataaagcaggaagcacattcctgcttgagctgggggagggcacagataaggctttgtccccagctcagttcgctcccatcccccacctgtgcattccgggactgagccttgtttgtgttctggagaggcccctgcagccgggaacaggaatgtgattactcccagaaggttgtgttcctgcagcccctgaacccacagtgcccctatactcccatgttcccagctggacctttttctgtcctcaggccccagctggaggccttctccccaggctcactatggggtgggggcttttcctggctgcaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggtgaggcttgtaggtggagaggggcagaggctcaggggatcaaggttttcaagggcaacctagactgatgggaggagcctagtagcatctcccctcctagtagacccacagacagagtgaagaagttgaggccagggctgtttaaactatcttggctgggcatggtggctcatgcctgtaatcccaacattttgggaggttgagggatcgcttgaggccggcagtttgagaccagctctggcaacatagcaagactctgtctctacaaaaaaattaaaaaaaaaaaaaaaaacaattagcctggtgtagtgacatatgcctgttaagcccagctgctccagaggctgaggcaggaggattgcttgagcccaggtgtttgaggctgcagtgagctatgattgcaccactgcactccagcctgggcaacagagtgagtctgttgtctctaaagaaacaaacaaataaggccaggagtggtggttcacacctataatcccacaactttgggaggctgaggtggaaggattgcttgagtctaggagtttgagaccaccttgggcagcaaagtgagactttaccaaaaaaatttaaaaattagtcaggtgtgatgttgcacacctgtagtcccagctacttgggaggctgaagtggaaggattgcttgagcccaggaggttgaggctgcagtgagctgcaactgtgcccctgcactctggcctgggcaacagaacaagactgtgtctcaaacaaactatatctcattctcctctctctgccccagaactggcatagaaatccatggtcaccctctaggtcacaacagccagggcctgtctctgaccaggtaggaaggactcttaggcattcctctggagcccctttccctcaggacccttattgacctagaggagccccttgaaccagctggatggccatcctgggaaagttctgaagggacctcatggtgtcatcctagctcatgccactgcacctccctcccacaggccagcagggccctcctcacagccgcacatcctgggtacctgtggtccttggtgtgctaacggccctggtgacggctgctgccctggccctcatcctgcttcgaaagagacggaaagagacrcggtttgggtaaggggatggggatgtggagggagaggcaggtaatgatgaaagaccttggagctgaccccaaatcctgggttttcctttaggcaagcctttgacagtgtcatggcccggggagagccagccgttcacttccgggcagcccggtccttcaatcgagaaaggcccgagcgcatcgaggccacatgtgagtggtgggtgatcgtgggaaggacaaatgggctgtcttgtgccccatctgcattcttttaccaaattattaatttgactgatatgtctgaacatcagtgagccccaggcacacaaatctgcctgtgtggagttcaccaccccagccrtgggagacctaagctcatctctatgctctgagggcagagtctggggtataagaggctgggttttggctcaggaatcagagatccctctttcccacaaaccctttccccacagtggacagcttgggcatcagcgatgaactaaaggaaaaactggaggatgtgctcatcccagagcagcagttcaccctgggccggatgttgggcaaaggtatgtgaggctgtgtggggatgggcatggctggtttgctgtagctggaagtgtttggttgcccctgtcactttgaggctgtgggtttgggtcggttgccgtaaacaagatatgcttgtagactcctgagtgtgggatgtttgtggggaatggtggctggagacagggagggctgaggagctgctcccagcatgctcttgctttggctactggcaagggtgccttctccactggccccagagtctgctgactgtgttcccatggagggtcacttgggaggaagrttggcagggarcagagagccaaggagactctcccttacttggattggttcctaggagagtttggttcagtgcgggaggcccagctgaagcaagaggatggctcctttgkgaaagtggctgtgaagatgctgaaaggtgagtgggggatagctgtagcctgagggcatcacttggaagggtaagaggggcgactgaccctgaagcaggctctgctttgcccctagattttccaagaagagctgggcagcactaactgggatgctctttaccacacgaataattcacaagcataaacccaaacatacatattcatgcccagccattgctctctgccatcggcagtgactgtcctctgagtcccctcttgggtgattacagctgtggttggttgacctgctgggctgcccaaaccaaagggaagggaaggcattagcaagtggagaagttgctaagtatcaccactccttgggggtttctcctgctcatggctgggctgtttcctgggctccctgggaagcctaggacatctgaaggacaagacctaggaggcctgggtcaaaactaggggcacatcttgttttatttcctccttccccatccccttctcctagctgacatcattgcctcaagcgacattgaagagttcctcagggaagcagcttgcatgaaggagtttgaccatccacacgtggccaaacttgttggtgagcccatttttgggggaggcagatagagaatagggctaaaaatatgctctaccaatatgagatggcagcctataggagagacttttggactcatctggtaaataaatagatggcaaaatagcaaggagggtcctggcagaaatctgaggtgaggagtgccaaaggtctgcacatgaagactgtgtggctggatgtggtggctcatgcctataacctcagcactttgggaggctgaggtgggagaattgcttgaggccaggggtttgagactagcctgggcagtatagcaacagcccacctctatttaaaaaaaaaaaacaaaacaaaaaacatacacacacacacacgtatacaaaaattagctaggtgtggtggtgtgcacctttgtccagctacccgggaggctgaggtgggaggatcatttgagcccagaacattgaggctgcagtgagctgtgattgcgccactgcactccagcctagatgacagagcaagatactgtttcagaaaaaacaaagactgcttgtgtggacagagaaggaaaggaaggggacagaagatgctccagggatatgggagcagccagagtccctcctgggtagtccccagaccagtgtggagcctgtgaaaaaataaaaaataaatagcagagccagagctagagatgggacccagcaggtggggacttatgcagacacctgaactgccccttgacccttctatgctcagctcctgactctcccttgtcccaggggtaagcctccggagcagggctaaaggccgtctccccatccccatggtcatcttgcccttcatgaagcatggggacctgcatgccttcctgctcgcctcccggattggggagaacccctttgtgagtacctgstgtgggggtggccaggaggaaacgggtgggaacacagggcctggaaaggcatagagaccctggcagagaggggcttgctgggtagggctgatggagctgggtgggagtaggaggggtctgagtttgaatccttttaatctagcaggctttcttttctctcacaaaaccctgctgagaaatataggctgggcaagggccctttctagagggagggacttgtggagccccagggtgggggagtctcgtcttccaggctccctcttaggctagccgaagcttccttgccttgggaaggccctccatccccttccttccttccagtgattctggggacagccttcaggctttctggccagggacccccatccatcctgccccagctgggtgggcaggttaagcctgagcttggcctgtctgtccactagaacctacccctccagaccctgatccggttcatggtggacattgcctgcggcatggagtacctgagctctcggaacttcatccaccgagacctggctgctcggaattgcatgtacgaattctggaggactcgagggtgggagacagcagcaggtgccaagaggagctagctgatggtcggctcctgcctgggacagtatctgctatgyatgggggtagcttgggagcaaagatgcaaagatgtcctggctcttgtgggcctgtgagcatggcagaaggctgactctctcyctcaatgccccttgtaggctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtggtgagcagggtggcccgtgaagcttggtggggacgagtgtgagagcagacctttaggatccttaagggcctagccaagtctgctctctggggtttggttgccccctgatgaggccctgagccccaggttgtgcttgtctcagagccatggctctctgcctggctcaggacacctagtgayagcttctcccccaacctcgattctgtcccagtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtgagtatcctgggaagggggctctggaaggaaaggggaatctggagttttggctgatggctgccaccacagttgcctcaactggacctttgttttttgatagaaacatccttgtagttggaaggctgcactccacctcatactcactgttcatctaccacctccctgttttctttctttccccctttcccatcccagatttcttgctttagcctttgtctatcagtctcttttctccagtttgtaaggagaaccaggaaccccaagagcagaaggcacagtgctgagtaacagtgtgggaggtttccctgccatcttcccacccgtcattccttttctttttttaatttgtatttattttattttatttgttctaccctagtgaatacaacctttgtcctggagacmccagctagtctaagaaaacttcctaggctgagctctcttgggaatctaagataaagaactgagatcctgggaagaagggaactgcctcctcttctttctgcaagcccaaagccctcgggactgggcaggcaatgataccacccactttgctacagtgataacagaccctgtgacaagataatgggaagtgtcactgacattagctgggcatttaggcattctttcaggtaatcttcctctgaccttatgaggaaaagactattatttatccccactttgtagatgagaaaataggattagagagattaagtaacatggccaacgtcacagagctagtaagtgaataagttggaatttgaacctagatccctgtagttttagaatatatactcttaactctttatgacaacaactgtgatttgtctgttctagtcttacactcccactccatccaagccaagggctccctaggccttcagacaaccttttgtgagtattttttgttttgttttttgagacagggtctcgctttgtcacccaggctggagtgcagtggcgtgatctctgcttactgcagcctcracctcctgggctcaagtgatcctccctccccagccttccaagtagctgggactacaggcacgtgccaccacactcrgctaatttttgtatttttgtagagacagggctccgccatatttgtcaagctggtcttgcgctcctgggctcaagggatccatctgccttggcctcccaaaatgctgggattacaggtgtgagccaccacgcccagcccagaggacctttcatgagccccagggggagtgggagccactgtgaccagagaaagaatctgctccatttcttgctctgggattggacttccagagggccgaggtcatggacaggcacaggaaggctcagcctgatggtggggtccttcccttggacagtgggtttgaagtgccctgagcctgggctgtgggtaactcacctacacctgagagggaaatcttgagtasacaagccaggccctggccctcctgttcattcagcagagctcagggcatggcaaggggcaggaagctcacatctccctgtggctgcagcctgcttcagttctaatctggcgctgtagaagctctgaagggcagtggggaccagaccccagcgcagcctcctccccagctggagctggtgctgtcaatggagagtgggcaggcactggcctcacccaggcagcctggtggacaggcgccagttggctcctagcacagccttgaggacgtgtcccagtctggccatgtacccacggccccagaccattcccattcccacgacctgttcagtgtctggcatgwttactgccattactggtggcccctgctgggggtgtgctggtgtgtgaggcagtgcttggggctcttgtcatgggcataggcaagagagtcaggcatttgcattcattggacttggtctcagcgtctttccattaggtttttggtttgttatttttccacctgagcctgaggcattccttgggcatcctgagtgataggcttcagggaatttataaggttcctgaaattgtatgtaaaaaagcattcctggcaggggacggtggctcacgcccgtaatcccagcgctttgggaggcggatctcctgaggtcgggagttccagaccagcctgaccaacatagagaaaccccgcctctattaaaaatacaaaattagctgggcgtggtggcgcatgcctgtaatgccagctacttgggaagctgaggcaggagaatcacttgaacccgggaggcagaggttctggtgacccgagatcacaccattgcactccagcctgggcaacaagagcaaaactccatctcaaaaaaaaaaaaaaaaaaaaattaattcctgttggcaggagagctggaagctttttccagatactcaaaagttatatatgaatagtgaggactttttcttttttttgaaatggagttttgctcttgtcgcccaggctggagtgcaatggcacaatcttggctcaccacaacttccacctcctggattcaagcgattctcgtgcctcagtctcctgagtagctgggattacaggcatgcaccaccctgcccagctaattttgtatttttagtagagacggggtttctccatgttgatcaggctggtctcaaactcccgacctcaggtgatctgcccaccttggcctcccaaagggctgggatgacaggtgtgtgccaccttgcccaaccaatttttgtattttttagtagacacggggtttcatcatgttggccaggctggactcgaactcctgacctcaagtgatccacctgcttcggcctcccaaagtgctgggattacaggcatgagctactgcacctggcctgattcagtaggtttccttttttttttttttttttttttttaaaaaaaaaaaagagaaagggcctcgctctgacagccaggctggagtgcagtaatgcaatcacagctcactgtagcatcaaacccctgggttcaagagatcttctgcccagcctccctagtagctgggattacaggtacttaccaccataccttgcttattaattttttttttaatagagacatggtctcgctatgttgtccagactagtctcgaactcctggggtcaraggatcttttagcctcagcctcctgagtagctgggactacaggtgcataccactgtgtccggctgcacggtgaggaattactgagtaggtactgcccactcagcacaggagggacttcggagtcaaccccctcgcttcaaatcacagctctgtcactttccacgtgtgtgactttagtcacggttcttaacctctttgtgcatgtttccacatttgtaaatgtggaaatgatttctatttgatcattgctttcatagggttgttgtgagaaataataagctaggatgtgcctgtaatcccagctactcaggaagctgtggtgggaggatcactagaggccaggagtttgagaccagcctgagcaacatagcaagaccctgtctctacaaaatattttttatttatttaatttaattaatttatttgtttgtttatttattttgagacggaatttcactcttgttgcccaggctggagttcaattgtgcaatctcggctcaccgcaacctccacctcctgggttcaagcgattctcctgcctcagcctcccaagtagctgggattacaggaatgtgccaccatgctgggctaatttttttttgtatttttagtagagatggggtttctccatgttggtcaggctggtctcgaactcctgacctcaggtgatctgcctgccttggcctcccaaggtgatcccacctcagccttccgagtagctgggactacaggcgtgtctaccaagcctggctaatttttgtattattatagagacagggttttgccatattgcccaggctggtctcgaactcctgggctcaaataataccccccttcggcctcccaaagtgttgagattacagatgcgagccgctgtgccccaccagggaataaaattttttaaaaccctagtgccatatgatgaaggggcccctgcttttgagggaagggctcctgccttttctcacgcttctctccaccccaggtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgygggaggcagcctggagctacctggcrgggatcagccctacagtggggctggggatggcagtggcatgggggcagtgggtggcactcccagtgactgtcggtacatactcacccccggagggctggctgagcagccaggrcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcasaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttrgttgctgtttaaaatagaaataaaattgaagactaaagacctaaggttttgtctctttttttttttctttttttttgagacagtctcactgtgttgcccaggctggagtgcatggtgtgatcttggttcactgcaacctctgcctcctgggttcaagcgattcttgtgcctcagtcaccagagtagctgggattacaggggctcactaccatgcccaggtaatttttgtatttttagtagagatgtggtttcgccatgttggccagggtggtcttgaactcatgacctcaagtgatctgcctgccttggcctcccaaagtgctgggattacagtcctgagccaccacacctggccccagctttgtctcttaaatgtttactttttttgagatcacaaagatgaaagatttttatagagagaaaagtctggaaagacatatgccaaaatgttaacagctgttatctttttttttttttttttgagaccgagtctcactctgtcgcccaggctggagtgcaattgcgcgatctgagctcactgcaagctctgcctcccaggttcacgccattctcctgcctcagcctcccgagtagctgggactacaggtgcctgccaccacgcccggctaattttttgtatttttagtagagatagggtttcaccgtattagccaggatgatctcaatctcctgacctcgtgatccgcctgcctcagcctcccaaagtgttgggattacaggcgtgagccaccgcacctggcaacagctgttacctttaaatgatggggttaaggggacgttcttctttgtgctttccaagttttctgcattgagcacaaaatgcttttgtaattagatacaggatcccaatgaatcttattatactgaagataatacagagtcaccgtgggcagttagaaaaatgcaaaaaatcggctgggcgcagtggctcacgcctgtaatcccagcactttgggagacctgggtgtgtggatcacgaggtcagaagttcaagactagtctgaccaacatggtgacaccccgtctttactaaaaatacaaaaattagctgggcatggtggcgcgtgtctgtaatcccagctactcaggacactgaggcaggagaattgcttgaactcaggaggcggaggttgcagtgagtcgagatcccggcagcctaggtgacaggcgagactccatctcaaaaataaaataaaaataaaaatgcaaaaaataataaaaggtgccagttacctatactcccaccacctagagataatcaccattgatcttttgaaaatgcaaatattcagctgggcacagtggcgtgtatttttttttttttttgagacggagtctcgagtctctctctgtcgcccaggctagagtgcagtggtgtgatctcggctcactgtaacctctgtctcccaggtttaatcaagtctcttgtcttggcttcccgagtagttgggactacaggcacgagccactgtgtccggctattttttgtatttttttgtagagacagggtttcaccatgttggccaggctggtctcgaactcctgatttcaagtgatctgcctgccttagcctcccaaagtgctgtgataacaggggtgagacaccatacccagcttgtaatcccagcactttgggaggctgaggcgggtggatcacttcaggccgggagttcgagaccagcctgggcaacatgaaaccccatctcaactaaaaattcaaaaaagtttagccaggcttggtggcgcaggtttgtcatctcagctactgggtgactgaggcatgagaatcacttaaacctgggaggaggaggttgcagtaagctgagatcttgccactaaacttcggcctgggtgacagattaagactgtctcagaaacaaaacaaaacaacaaaaaagcttttagagcaagttcatgggagatgcagcaggaggcgcaggaaccacacatgtgctagtgaggagtgtggggagactgggagggcccacaggtattgtgctgcttctggctgagggcaggggaatagggtggctgcttctgaaagcaaatatcctgaaaaacctgttgctggtactccaaattctggttcccatgtagatcatgaaacctgaaaaacttccaggcaagtagctttcagaatctttcctgctgtgattagctttcactgcaggtagtgattacctgtgagataacatctgggaattattgattgaaaagaccttcactatcggttgggggcggtggctgatgcctgtaatcccagcactttgtgaggctgaggcgggtggatcacctgaggtcaggggttcaagaccagcctggccaacatggtgaaaccccatctctactaaaaaatacaaaaactagccaggagtggtggcaggcacctgtaatcccagctacttgggaggctaaggcaggagaatcacttgaaccctggaggcggaggttgcagtgaactgagatggcaccagtgcactccagcctgggtgacagagcgagactccatctcaaaaaaaaaaaaaaaaaaaagaggccaggcatggtggctcacgcctataatcccagcgctttgggattttctgtctcaaaaaaaaaaaagagagagactctggatcaaaaaggattttcacaaacagatccaaagaaccagcatccagattaagaaacagcattaacagcaacccagaagcaacccttgggacctgcctcaatctctgcctcctccctactccccataggtaacctctatcctgacctcttaacaccatggatcagtgaagctccttttaaaagtatataaatggagtcatgtagatttgattactttgcgtttggcttctttccctcagcaacatgtttataaggatcatctaacaacagcagttttgaaaagtgagtctcaaagaggcaagaatggccgggcatggtggctcacacccgtaatcccagcgctttgggaggccgaggcgggcggatcacaagttcaggagtttgagaccagcctggctaacagggtgaaaccctgtctttactaaaccctgtctttactaaaaatacacaaaattagccaggtatggtggcaggcacgtgtaatcctagctactcgggaggctgaggcaggagaatcacttgaacctgggagggggaggttgcagtgagccactacattccagcttgggtgagagagtgagactccatctcggaaaaaaaaaaaattagctgggcgtgctggtgggtgcctgtaatcccagctacttgggaggctgaggtaggagaattgcttgaacctgggaggtggaagttgctgtgagacgagattgtgccatggcactccagcctggacaagagtgagactccatctcaaaaaagaaaataataataatatagtttatttttcagtatttcatgttgatttatctcaaatttattgttgaataagaagtgatacagagattcaaagttatttttcccagatactttttattgtcccaataccaccatttattgaacaatctatattttatgcacatttcttttttttttcttttttttgatacagggtcttgctctgtttctgcctgggctggagtaaagtgatagtaaactgattctcccacctcagcgtcctgaatagctgggaccacaggcacacgccactgcacctggcaaatttttaagtgtttttttttttttttaatacagagccttgctctgtcgcccaggctggagtgcagtggtgtgatctcggctcactgcaacctccgcctctcagttcaagcgagtctcctcctgcctcacactcccaattagctgggactacaggcacgtgccaccacaacatgctaattttttgtatttttagtagagacagggtttcaccatgttagccaggatggtctcgatctcctgacctcgtgatctgcccgcctcagcctcccaaagtgctgggattacaggcttcagccaccgcgcccggcccagtttttaagtgttgtagagatggagtcttgctttgttgcccaggctggtcttgaactctgggctgaagcgatctgcccaccttggcctctcaaagtgcggagattacaggtgtgagccaccacacccagccagaatttcttgaataatctgtctccatttctctatatagcctcattgatctatctaaactcccatatctattttggttgctagactgttcatcccaattacatgtgccagtgtcactgctacactaattgaattactataaatgtataatgttttcctatatgttcgtggtacattttttttgcaacgttctcccaaggtctgaggaacactatgtcaaggcatggcatgaaaggaatacaggtctcccaaggctttagagaagaatgatttgttcatggtgtcacaaagcaaggggtgaggggcacaattgggatgaaaacccagggatctacgtaattcctccatctttccactgccccagagtgggaaggtaggggtagctgagaggttttgaggaccagaggatagcggggagtagtctggatagacttttctgtctctaagtcctgttaactccactctcctattgcttttgcatgggtccctccccagctatcagcatcctgaggcctcctctctcacccagagtattgcaacagctgtgcaaaccttcctgacgaagaccaggtcagcactcctttggttatgaagccgctgcccccaacacctgtggaatttgtcttcrgggttctccttcctgttttgtaattataattatctcgagaggccgaggtgggtggatcacttgaggtcaggagttcaaaaccagcctgaccaacatggtgaaaccccatctcaactaaaaatacaaaattagtcggacatggtgtcatgcgcctgtaatcccagctactctggaggctgagacaggagaatcgcttgaacctgggaggcggaggttgcagggagctgagattgtgccactgcactccagcctgggtgacagagcaagactctgtctcacaaaaaaaaaaaaaaaaaaaaaaaaaaaggcctggcgcggtggctcacgcctgtaatcccagcactttgggaggccgaggcgggcggatcacgaggtcaggagattgagaccatcccggctaacacagtgaaaccccgtctctactaaaaatacaaaaaattagccgggcgtggtggcaggcgcctgtaatcccagctactggggaggctgagacaggagaattgcgtgaacccgggaggggaagcttgcagtgagctgagactgagccgctgcactccagcctggcctgcagagcgagactccataaaaaaaaaaagaaaaaaaaattatctctcccccttccctttcctctccatataagttgtgtgcacacagggacctgtcttttttattatggtatcctcagcgctttcgcacttcgtaggcactcaatgaatattcattaattgggtgtgggggtaagggaaaggaggggtctagtaaaatttataactggcgatttggtggttggtgagagtattgagtgcgtgcctagggcgcacaggggaaaacactggtaatatttacttcacgagacctttttagaattaactaaaagtatctaagggcctagaagagttcctgacaattggccaaagttcagtaaatcttagagaacactcctccccttttctccaaattcctcagtttttccccagggtagagcaagagcaaaggagagaagccttttgggccctccctaagccacagacaggttggggaagcctctggatcattaaaaggcagaaaataattttacatttggtcctctaaaaccccacaagccccaaatcagaaggctgtgcctggacttagctcgagcgagcccagaagcacctggtgggatacgcagctgtgccccaggcatttctacccacgggctccggccagagaggctcgcgctaggcgggctgggcccgcgggacgaatcctcacctctgcggcccactcgagagcggggccaca

SEQ ID NO: 12382 - DNA, 85086 bp, Homo sapiens
gttcgaccatcctgtcacataaatcttttctcctggcccataagaataatgaagccaatggccaaactgcaagccttctcaattcggtgttttttttgcagggtcatgtcgaaaggtatttgaaacacgcttagaatgcatgttgaagatttatgtctccgtgatgggcagtttctgccccaaaggggcagcttcagttgttttgattgtcattgctaagaacatcaggaacagatgtctcgagctgccgaggcatggctctgcgggcactgggaagcaaagccatgcggaggcctgtggctggtgctcagaggtcacttcctggtctgagaattgcgtttttcattatttacctggtgatacttagtgaataatatcgttcaagggtagagtacacgaaacaggtatttcttacgtctcccctcccccaacaaatgacagaaccagttatcaaataaatacaagatactaaccatgtgagatttctgcatgtggtaaggtttaatatctctttgagcctcactagattttaggaaggaggaggttgcagaattgtggcttgccaggagttgtatgacctcttcaaagtgacattagtttaactttgttttattttattttaatttttgagactgagtcttgttctctcacccaggctggagtacagtggcacaatctcggctcactgcaatctccgcctcctaggtccaagcgattcttgtgcctcagcctcccgagtagctgggattacaggtgcctgccaccacgccctgctagtttttttgttttgttttgtttttgttttttgtttttttttttgaggtgaagtcttgctttgtcaccaggctggattggctcactgcaacctccacctccagggttcaagcgattctccttcctcaacctcccaagtagctgggactacaggcatgtgctaccacgcccagctaatttttgtatttttagtagagacgggatttcaccatgtaggccaggatggtgtcgatctcttgaccttgtgatccgcccgcctcagcctcccaaagtgctgggattacaggcatgagccaccgcgcccagcatttttgtatttttagtagagatggggtttcaccatgttgaccaggctggtctcgaactcctgatctcaagtgatctgcccaccttggcctcccaatgtgctgggattacaggcatgaaccaccgcgcctggcctggtttgactttagaattgggacctgcaccagcttgtagtggattgggcctctgctgtgtctcacccagcagagaccagaccaaggttgctgcagaaggggatcctactgcggaatgggctgcatcccacaagcaaaacacgggtggcaggctggtccttctcattccatgagctttcacgcttgtcattcatgaggctgtgaattccccctcaagttagccctaagagcttgtccaacataattactgtattgatctcaaatagagggcatcatctgtttctccccaacatgctttaaaaaaaagggaaaaaaaccctgctttcaaggacttggagggcctttgaagtgaaattgctctcggacagggagggaggcagccttataacagcagctggaatggctgcttgaattccaaatctgcgttagtgctgccaggcgaggcaggccctcagccacaggaagtggggcacgsactccagggaggccaggaggccgacgcagccactgcctgggttggattgttgcctgctggcacactggcctctgcacaattctatctgggttttcctttccctggtgctctggtgttttgtaaccaagggaatgctaagctgcaaccagttccttttatgatcctggacaagtctgttcccctttgagcctcggcgttctctctgaaaggaagtgggatgtgtagaagttgtcaaacatgaactccgtggaagtagatagtggggcctcctcccacacccacctactcccttgaggaagctccaggcagtacatttggaaagctaccaaacaggactacctctcaggacttctcttgttttattagtctctgagctgcctctttggttggtttatctggagtttttgtagcatcttctcactcatccacagcatgtcacttgttctctggatgaaggaggctccaagtcatgctagactgtggagttctggaactagagtatactgtttatttcctgtactggaagccagagttagggccaggctggattttatgtctgcacctaaaaccattcagtcccccacaaatgaatcaacctaattagtgctagactgttgtagctccctgagagcagggctctggccatcttaccactgtattcccacagcggcccgcatgatacatcctcagtaaggaaaaatgaatgactactttggaatctgttagaagttttcccgtggccccttgggggagagctctttttactactttggtttgaccagtactgtccctaccttcaggcttttcttctttgtcctcaaaacagggacttcctaactattcatgatccaaagtcctctaaccccaggggtagtctctgtcatgtctgctgcaccaggttggcagcctcccacccagacgggggccgctggcccttccctgatgcgtgtgccctggcgccgactgccactcttcatcctgccttgctgtggttagagtggaactgtcctctgctccaagccgcccctgaagcccaccctccttgccggcctttcctagaccttacctgtggctctgtggacagcacaccttgaggacttgctgctttggggttttcttcccctacttgctctggtgggcagttcctatctcagtttttctcccatttgatctgactgggaaggagtgggcgggcagagatggggagttatttccaagaggcatcattcccattttaggactgttcccccctccctcacctgcagtctcatgcattatttggagtttaccgtggtgccacccatgttttcgttctccagcctttttggatgccagatttttaaagccagctttcatttctcagtgatcgggagcacagagatggtggctgggtcgcaatgtattaagtgtctgagacaaggcttgtgcccagaggcagccatgcgtgagtggtcagtcctgagtggtttggattgaaataggacagggaaagcaaagctccggggcctttgtccaatcttccccctcagtagctaggctgcatgccaagctctgtgcccagccccctacggcacgtgctgcctcctcgccaggggccctgacagtctcagaatggtgccccccaggacacatgggagattataagcctcttgcattgagggaggttttctgtaaaggggaaaatgctgtaattgaaaagctccttgattataaagaagaaatagagacgcctggcatagaagagacttcgttctttggtctgctcagccagggtcggggacattcagtacccccaggctaataggctcttgagctcttaaggaccttggagtctgcaggtccagactccagaaggttatgggaccatgaagaggtcacacagctgtaccccttggcttgctgcatttctgcatctccagtgcctccatctgccccctccctccagctcaggtgggacacctttgtctccactcagcactctgggatgtaccatcagcaatgcctggccagaattgagggtctctgtcttaaagcgtggaggagaaaggggcccttttggaacaggagttagggaagcaagaagcatgaagattgtgctcagaattgaattcagggagcaatgcataaaaaagcgagaggatgggtagagatatggtgcttaaaaggatcctggaatccatgtacttctgagatctgtgagccccgcccctgctgaagatgagccagccccacccagtacatgctgcccttgaaggtctataggcattctgctggcatttcctaagtaggatgtatttgaccaagcatctcccaggaccagagccctgcaggacatacctgtctagggcagttgctatgccccacagtcccttcaccatcatccccagaagcgcctcggccagcctcattcaacttcttgcctttttattacagtgtttgagccaactatatagtcctggtgtattcctaggcaggagatcaaagggccccccgggttgggtggtccatgagtgagcatgtgataccgcaggagtcttcctcctgccctgacaacttgccttgtactaccagtgctgctcaggatgtctgcagccacgaagcttcattataaatgcaggagctcaggctccaggcccactgaatctgaatctgagtctacagaccgctcctgcactcttagaagtttgagaaacccccctgggctggggtctctttcccatatacagctagggaagcttgctggagggaggactgaaaagaacaagtgcctgatctaccttcccctctgccctttcacaggtgggtggatgcgtgggaagagggtggggcatttcctgctattcccccttattcaccttttctccacggggattagagtcttgaccggaaaacatggctctggtccccagcccctatgggactgaaaacccggaggcttgcatgtctcagatcctccagaggctgatgtaagagttgctgaagacctcggatctttccttttgtgaaatgcagcccatgtggccgggaaaatagtgggagctggaagtaacagttgtggttttaagcacacagtagatgctcaagaaatatattgagtacatgtcttggactttcccctccctaaatattatctgtcaagtgggcctattggacttgttgaccttggagggccctgtcggcttgacccaccaattcgaaatggttgagaaagaggtctgtctttgtaccttttgcagcctgttttcccagttcttagaacattggggtgagatccagagatttcagagatccccctggaacacgagtgttctgtgacgagttcatgaccttggagccaccaaccatacccctcacccgttgtccccagttctggccttgccgacccactgcgtgtttctttgcttcatgtgggctgttccccggggagggagctcagtggagaacagaaagaggtgtgggtgagggctcccccttggtggggagtggggcacaggagcctcaggctctgttgaccatcaaagaagggactcgagtgggcaggccgctcacttgctgtggaccttgggcaagtctctaactctccctgggccttggaagtcaggccgaggtgatctctgccgccccctccctgcctgggttttcactcttgttctgatcccactctcttccgggtgcctcccttccacttctccgtagcctgtggctcccctccccacacccgccctgggcccgggttaggctggggcgggggcgagctgcccagtccagagacaaagtccaagagccgcgaatgggctggcgagggtcaaccgcgtggcctctgccaggaagcgcgccgagcgcccgggtgaggagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttgggtgagtgcgccccgccagggctgcggccctggaaaggggaaggggacagaggtgtccagactcccgtcggctcgcagcgaagaccccgcgcgggcgggcggggacggagggtgggggcgaacgcgtgggggacccgggtctccaggggcgaggggtgggcgcagctgggctcgcgcagcccggtcttgacagcagctggagaagtggggggaggcctggactgagccggctgaacccccagcctgttggacttggtccaggccgcggccagggggctttggtcccacccccctgggtgggtggggagtccagttttccgcccacctcgaggtgggggcgcctggggtttagaggagggactgtgggaagtgggcgcgtttcctccatccctggggaggggcccaagccctagcgccccccagagggtggcgctcctgtcctcagaggagggaagtgggggcctcagatcaaggaccctgagcggggagggcggtgatgtccttgcatccccagagacaggacgcattcccctgtccctgacccccgcggcagagcggggcacacgcgtcacgaagttgggcgccccctcgtcgcctcccctggctcggcaggatctgaggactcggtgggaattcacggggcggtttccgtgccctgcagggtttggtgccagctgcggggcgcctgggyttggggaagaaaccttgtgtacgcacacctgcacacacacacagtctccggaggtgagcggccccctccctaccataacagaccccagcctgtgcatgccctcggagtccttgttggggtcatagcacaggcccggtggtggggtcaggaagaacatccactgttctcagggctcattggcctctgtccccgggctccattcccctccctgccaagtcagaggtcaggcccctggggcggcaggcaggaaggacactgagggaaggggcactgaggcaggaggggcactgagggaagctggccaggtggaagtaggagagaaaggcaatgggggtgagatggtaccacttcctccccatatgaggctctcaggaggctcctggccccccctgcacaggtagtggtccctccttcctgagggtgtttgggggaaaacgctatggttggggcactggggaaggttgcctcgcagatgaaacagaacattggccaaaggtgtccctgaatgggcttctggactggcacagggccctgagggctgtggctgagtggggaggcagtgatcaggtccagctggccatgggggccccccattcccttctccatgacctcagcctcactckgagagcccccagcagctggaaggtctggtaaggggtgcgtgttccttgatggccttgggaagggttccagggtaatgattaatcctcaggtggcacgagcaatttcccccttcacagcaatatttcagggcaggcgctgaagcctccattgcacaggtgaggaaactgaggctcggagaggctaaatgaactgcctgaggtcacctagtcaccttcagcaaggtctagaatcgtggtactctgactcttgatgggagaagatctccacagcggtggagaggaggaagggtgaacgccgtggtggagtggtccatgtggacctgctcccctttgctgccaggaggtgagggtgcctgtggctggaagctgggtcaggttgaggagagggtccagagtcctaggcttgccttgccaccccttcccatggagggagggttgtccmgtggagcaccataatggtgctttcaccctgggaccttcccagcttgcttgggcaaagccctctcctcttctcttcttcccaaggtgcctgcctggcaggggtctcaggaggcccctctcctggctctaactaccttccacccttaggagacaagaaggattcttyctttggcctcttggagggcagcagggagagaggtctctgccacttaggcctcaggctcccacagcagggcctccacctccctctcacctggccctgcccctgccctgctgtcaaattctggggccaagaggccctttgaggactcctcgggcagatctgtcctccatgctgccatctgtctacggaggcctttgtcctggctgtcagaggctgctgagcagccgcaygtgctgtgcaaacaaccgagacctgagcacggccagacacaaacgcaaatacagttagactgacagataccctgagacccagacacaggaacacacgggcacacccaggccaagacccctgcccccgactctgcctgacacacaagcactgagagtcacaccatccagatgctggcacgtgtgtacacacagagagacggaggttgtcagcaaggrgaagagccttttcagaagccctcgtcttctgtcgtctgcctccattatctcctccagggtgcacacatggtacacgcrcatgcaggaagaacacgaggatgccctacgcccttaaaaatgaacctggcagacacgcacatgcacccacccacacccaggccatcatgggtgcacacacgcatgaattacatcagcttcctgcgtgtgggatgtkaatgcttcatcacccggggaggggagtggaggcccccgaccgtccccagcaaagcctccccttcctccctcttttctgattcatgtggacccagcttgactggccccaagaatcctgggaaactgcctrgtgcttcccactcagtggaccctcctctcctgcctcccctctgtgtacatacccagcgggttgccacgggagcctctccccaggctgctccwttgctgtctctgaaggtgttgttctgcaggtccttcccaagacaggacaggacccagtgcaggctccaagcggctctggggttccctttcctttccacttttgctagaggcattaccaggccccagtttctgctttgtcctcccagcaaggctgggggccagctggtgtgaagggaagggagccctcagcactctctgctcacctccttgcatgccaggacctctgccaggctggccctggcaccctgtgcctctgagagactggcgctgtggagaggtgcttctgtgggcttaggtgaggcctccagggcagacatgctagatggggaggggctcccagctccaccaygctccctcggcactcacaccaagcctgccagrgtgctgattccctgtccaagcctggccctgcctcttgctggctgtgtggcccggacaagtcattttccctctctgggcccagctccagctctgggaggcagctcagcctggctgggggatgaggaaagtcagaggtgtgaggtggcagccctgtgccaataaggaaaggaagttgggctctggtggcagtgtgggcccatggggccccaggctgatgacttcctgcagagtgcagcctctggatccacactagggccaagcaggggtcgccagtctcagggcttcttggggcggccaccctggggtcagcccaggaggagggtacccaagggcagtgggctgcagctatgttgctcacatttgtggacattttatgcctcaaaatgtgctctatatttagggctaaagaccagcactgtcaggcaggtggtgactcagagaggaagaagggaaaagaggcagaggagtgctggtggggagacaccccaaaacagaaaggtcccactgggattccagcctttcctactgcaagaaaggaagcaaaacatgatactcctgctttgcaccagcacaatgggagcagcctcgtgtgcctrctcactaagcatttaatgagcatgtagtggatcccagggactgtgacaggcactggggcacagagatgagctgggtcctgtggtccctgccacagcccggtgctttgtgtcagatgaggaggtgaggctcaaagagagaaagtgacttgcccactctacaggttaatacctctgccaaccgaggccaccctccctcggacccccattcggaggaagcagacccaagttcgaattctgacattgccactgagcagccgtacaacttttggtgagttcctctctccctctgagtctgtttcttgatctaggaagtgggaatcatagcacttgcctgatgagtatgtttcaagggataagaaggtgaatgcaagcaaacactgagggcagtgcccagcttatcctaggcattctgctgggtctaaaaggacatagattgggagtcctcagaatgccaaatccagtctctgctgtgtgactttggaaaaatcacctgccttctctgtgcctcatttctttctccctagaacggggatgacgagcttttatttgcctgcctccctggggatgttgtttgcgaggccagacatactggctgggaactgctttgaaaaatataaagctgcactcagagaaacacagagagacacactgaaggaaaagcaaacacaaatctggagaaaaatcttttctaaaaacatcmaatacttctctacagccagaaaaaaaaataataagscttttcttcagtgttttgagagtagtgagaattttttccgtaacttcgcatttccaaagtagttggcatggctatcaccaggtgagctgggtaagtttcctccttgaggagtccttgcctggcacatattaggtgttcagtaagtgataatgttagtagtagaattaccagttgcacagcaagaggagaagtggaggcgctcctggaggcgagaccagctacggcgtgggcaagggctgggggtggcaatgtggacactgggttggattcatggaaggtgggggtagggacaaatcggggtcagtctattaagggccttgaatggcaggccgaggagtctgcatttccccaaaatcaatgcaggatacacgggaggggcaggctgagcccactagcctggaatgaggaaccacctggcgtagttctctgccctgccactgctgtgtaaggatggccccctcgcctgtttccctgggcctcattttctcccagtgtgcaaaggagaggattccagcctcttccatcccaggggcaggcaagaggatcaaggcaccaagccacccgggaactaggttgctatgagagctggagagccgggggctgtcattggttcaggaagtcaggaaccttgtgttccgcttctggccccaccccactagctgggtgagctcaggcaagccgcccggcctctttgagcctccctttccatctgtggaatgggaggatgtagtttctgtctttgcagtacagctcccatgagttgaagctggtgactgtgttgtgtgagcctcaagtgtgttgttgtatctctgggggaattgcagtatttcttgaaactacagtacctgttcctcagactcccctgagacggtggatctgctggcaaggctggggtttgggggcagtgggtgaggatcagatgcctgagccacctcagaggctgtgaccttctcaaggccacgggagccatgtgtctgccgcagccaggctgtgggggcagcagagggaaggtggaggtggggcagatgggtccagccctctgcttggctcctgaactctgggccccagttctgcgagggaaagccaccccagtaccctgctcagaggacagccctctccaaggcctcactccttgattcagggctcgaggggtagggtggaggtggctgatggagggtgaccttgggaacttcttcctgcctgcaagctcggtgccagaactgccagggcagccctgattcttcttgctcaaaagytggcagcgtcagggaccctcgagaggctgccaggacaaggcctgagctgatgtcaccatcaccagcctcttgcgtcttcccctgtgttggaggtccagagagaggccatccacccgctggcagactgctgtaggcactgtgcccacccgggcagcaggctcaggatgccatgggactgaagactctagccttgcctcattcaccacttgcctttcacttgaggtgtgggagctctgccagggatagagggttgcccttacagcccctctcccagggctccctgcctctagaaacaggactgggcagagccgctgggacaaagacctcacctgtccgagtccccaaagcccacagccctccctggctggagaggtgtgggctctgtagtcctccgaagggcagagaagcctgggtcctgcacaaactctacaatgctgggcccacccaayggcagtcagggtgggaagtgggcagctagctcaggaattctaggaagattctggatggggggaggcatgatggggcctgagcaattggatgcaggtggggscattcattgagcacttgcagtgtgctgggccctatgtaagcacttttcatggayctatctcatttaatcctcttagcaaccctcaagggctcagagaggttaaatagcctgccccaggtcacccagctggtgagtggctggggctgagatttgaattgagggttgtgtgactctacttttagccatttctgtgtactgcatgcagaatgagaaggggttggggagggcgccatacagaatctgtgctctgggtaatgggagcaattctgggcaggggcaggagcaggggtggggctgagacttggaggctcacacctgcaggacgtggccctgaagcttccaggccctaaagcttccagctccccctccccatggcctatccctggggcccagtgccccaggctggcttgggggaaaaggatgaatggggacaacttttcaggggttcctgtggacacacagtcccacagaccctgacttctcctggccccctacgtctgtgtaaattcccagcttggaaacccaagaaatccccagcttcagagctgggaaggagcccacagagatcagctggtccaaccccctygttttacagatagtaattatcatgattatgcctgatgggagcaattcacaaaggactttcacatctgggttgctgctgagtgtgccggagcccttggggccagcaagattcatccacattttgtgggtgaggaaactgaggttcatagaggcaaggagatggacctaggggcacacagttgaccttggtacaggtctcttccttctgagacccagcacctrtgtgacgtggctctggggctgcaccctgcattggagtggggctggtcctgagaggtctrtatggggccagggcaagtatcagatgaggttctgagattcccagtgatgcctgcctcctccctgtcacgggaacaccacgcccttcagtggcgtggtctgsaagagacagactggtgggcagagctgtttccaagagacttctctgcccaccatgcacatgggggctatgctgccccagaaaatcagattgagaagggcccttggaggggcctcattattcagagaagaaaactggggagctgcccacagtcacattgtgagccattggtggcactaggcttagaacacagatttcctggctcagctcacagctgtccttgcacgtgtccagtaatagtactaaagacagtctccatttattgtgtgcctactatgtgccaggggtgagcagtttacactgaatcctaagaacaatcctatgcggtaagtacttttattatcattgccatcctcttttacagatgaagaagctgaggctttgagaggttatgaaaatggaccaaagtcacaagccaggaagtggcagagcaggaatttaagcacaggtccatgtgattccaaacccatactgatgccaggccttatgtatattatgataggactaaagttgactttctgtttctttatgttcatagtcaacgtaggccatcattcattcattgaacatttatggagtgctcactaaaacaaggagactatagagctgatcagggttgagggtcagagattaggtcatgaggcagggagtctcagacactgctaagctctctgcctccaccaagaatggctgcgtctccctcctttttttttttttttggagacagagtcttgctctgttgcccagactggagtgcagtggtgcgatctcagctcagtgcaacctcggcctcctggattcaagcgattcttgtgcctcagcctgctgagtagccaggactacaggcatgcaccactacgcccagctaatttttgtatttttactagagatggggttttgccatattggccaggctgttctcgaactcctgacctcaggcgatccacctgcctcagtctctcaaagtgctgggattattacaagcatgagccaccgcgccccagccatctccctcctcctcctgtccccagctcagcccaactacatttgcagcctcttcctctgcttctcctgcccacctgatttacccctggggtaaatgaaggcatgactcagctagggctcctgggctttgtgtatcccaaagaagaccctactggcaacagtgttaacagccaccaccgtgcaagccgttcgtgagcacaaggcaccatgctaaggtgtctgtgtgcatcaccttgtttaacacgccatcactctgtgagctaagagctagtatcatctccattttccagattggaaactaaggctgacggtcacagctcaagactgagtcggggctgggtrcagtggctcttgcctgtaatcctrgcactttgggaggctgaggcgggaggaccacttgaggttgggagttgaagaccagcctggccaaaatggtgaaaccccatctctactaaaaatacaaaaatcagccgggcatggtggcgggtgcctgtagtcccggctactcaggaggctgaagcgagagaatcgcttgaaccctggaggcagaggttgcagtgagccaagatcgtgccattgcactccagcctgggtgacagagcgagactgtctcaatawatatatatagctgagttggaacccactctgtccagccctcttgagcctgtgcccttyctcactggctcacactgccctgctctgtatccaggctgtgtagttatgcatttagagccctggttcctggaaggcagggcttcagccaagcaacgggttattaagcacctactgtgtgtcttggggaggtgctttgtgaggctaaagcttgtgaggatggggagattgggttcctctgtgagagatcttgaggctccatgcccgcatcctatcccagaaggcattcaagcccgaggataccaggacagagcagccagggcagggcagtgtgtactgttggaaggactttttccctggcaggagcgtccctcacagtgactcagagcagtgtgaagacctcagagaggttttgtagccatatctgcatccactgatccttaggcaagccactcagcctctgggaccttggcttcctgatctgtgaaatggggaagatgattgtacctaatttacagggtgggtttaaggactggatgaaagcacttggcacagggcctcgggaactagaaggggctgtgccactgagctgcagcgcacgggtgatagggactgaggtcccgaagagctcggaagagctggatctgctctgtttgcacacctcaatttcccccgtcagccatggcagacatgtaactcttgcaggatcagcctcacggggctgttgtcaggatcacagagatcccggaacgcgtaggtgcggccccgtgatctgcgcaccgagagaacgggtcccgcgggagggggcggcgagagcacagtgggcgggcgcaggtgcgcccttgtgagctgggagacgtgcggcggcgcctggcgccggggagagggcgaggacgggcgctggggccgcctccatgtaagggaggggtgaggaagtgcggggggtggcgagcgcgcggccggtgactgggggcgctgtcccggcggctccgggtccccacccttctctgagatgctcccggggcgctgtccctggtcctggagcccgggcggccgtcgcctgcagttcttatgacggccaattggtggcgcccgagaccgcggcggactcccggacccattagagaacacgttttaaaaagcgttcttcggccgggcackgtggytcacgcctgttatcccaacactttgggaggctaaggcgggcgcatcacctgaggtcgggagttcgaggccagcctgaccaacatggaaaaaccccgactctactaaaaatacaaaaattagctgggcctgatggtgcatgcctgtaatcccagctactgaggtggaggttgcggtgagccgagatcgcgccattgcactccagcctgggcgacaagggcaaaactccgtctcaaaaaaaaaaaaaaaagcgttcttcattttcctgtcatgatattcctaggaaataagcctgcctacacacctgacttcaaaaaccaactatatactggcataagagatgaaaaaggccctccacctccctacatgaatgctgtggcatgaccacaccacaagagccaaagaagtaaccagccttgggcacctatttattaaaaatatacccttagatttaaaaaaattaaaattatcgtaatagagatggagtcttgctttgttaccaggccggtctcgaacttctgggcttaagcagtcctctcacctcagcctctcaaggtgctgggattacaggtgtgaaccaccttgcccagcctacccttagattttttgtttttgtttttgttttttgagacagagtctcaaaaactccaggctagagtgtagtgctgtgatcttagctcactgcaacctccgcctcctgggttcatgcaattctcctgtctcagcctcctgagtagctgagactacaggcgcatgccaccacacctggctaatttttgtatttttagtagagacaaggtttcaccatattggtcaggctggtctcgaactcctggcctcaggtgatctacccgcctcagcctcccaaagtgctgggattacagatgtgagccactgagcccggcctacccttagatttaagagcagaaagtcatgtcgctgtacctgacctctagttcagaatgacttcagtagctgcacctttgaaaaatgtattatggattaaagccacaccaaaaaatattcatttgtaaaccagagttaggttctaggatgggttacccgggctttttacccacttgaatatctaggaggatatctgatgaacaacaaatctcctgaagtgggactctcaccagcgtagctttcctgtcccccacccactgaatgacagtggcgaccccgtcatttctgaggactgaaaccaccctggcgccctctggggggcagagccacccttgttgagagccactgcctcaatgagggccttgtcggggtggagaggggctctcagagtcccagactggttggcctcctgggagggtggtatcataaggaactgttgggaaactctctccccccattatagatgaaccagcagaggccagaagtgggaaggcacttgtgatgagaaatggtgggttgccagcagagctggggccacaggcaggtctccccaggtcaggactccgccagcccagcttcctgaggggagctctgggcctcaagcagtctcccagctttgtccaactgccccgaaaatgggctgggagggccacgcccatagcagtggaggtaggagatgggggctggccggctagacaccagcctgtaatacatgagaggtgtcttggcctccactctgcaatcctggagatgcagcaattgcactcttctctgacccccaaagagccattctgtctcctacctttatttcttcccagtagttagctggatgctccatgcgtgtttgtgaggtgtgtacacatctgtctgtgtatattgtatgaacataaataatgtgatttgagtaaggatgtgtgggcctgagattcctgtgcctgtatgtgctgtcatcagtgtgtatttacatgcatgtactaacgcagccggagtcagtaggtgcatgtgcactgatgggggacctaagggtgggagctggagttgacctttgcatgtgcacgtacttgtgggtttgcagcatgggggctgatgttcatgtgagcctgtctgcatgcatttgatcttgatgtgatctctacaggcatgagttagatgactctttgcatgtgcrtggcacggtactaggccaagtgcatgtgtgacctgggaaagtttgtgtgcagttgtgcacacaggtctaccagagaccttgtctgtcttgttcagactctatcgccagtgtctgaatagtgtcagccacacagtgggtgctcaatacagtgtcagccacacagtgggtgctcaatactgaatgaatgggggaaggaatgaaagaccgtacacctgggtgctgcctccagaagggctttgcttycagggcctttcaagccacatgatctgcatggagatgagaaacacatcctcaggggtagggcctgagtgggggcaggtattctggccaggccagattttcctggtccctgatggrgtccctttaagtaggcaggggtttcagaaacccattgaatagagcaggagtctcagagccagggcagaggctggctcagtaacctcactggccagctgcctagggaagggctgtgagccaagtcacacccactcttccctcccttcccaggggctggggaacccccaggagactctttttccagaagcttcctgggattgggttggtgtggcttggctagaaaggccacaggcaaagtaaggataatgatactttcagagctagcagaattctctcaaggcaaatgtatctttccgttgttaggtctttttttttttttttttttttttktttttttttttagatggagtcttgctatgtcacccaggctgcagtgcagtggtgtgatctttggtcactgcaacttctgcctcctgggttcaagcgattctcctgcctcagcctcctgagtagctgggtgccaccacgcccagctaatttttgtatttttaatagagacggggtttcaccatgttgatcaggctgatctcgaactcctgacctcatgatycacctgcctcagcctcccaaaatgctgggatcacaggcgtgagccaccgcgcccagcccactgttaggtctttaacccagcaaagtgagaataggggtttaacatatgagcaaactgaggcccagcgaggaaaactgattaatgcaaagccacacaagaggctgcctgggccagggcaggaagcccagacgcctcctctcctgcccaagaggcctggggcagatatcctgaatgagtatgactcggggaggggaggaggctattggaggccctggcaagtgttggctccaccagccccacctagagcccagacctgagatcttcccagggtttgctcctccctctccccttccatctccctggaaagggggagctggaggtaggtaggtggaacacccagagttcaacaagaggtgaacttggaaaggcagctctgcaaccctccacccggtgctcttctctcttcctctacagtctggcagctgtttgaacaacttgggtacaaatctaggaggcccaaaggggaggcttcctctcagagggagggcctggaccctggaaagcagcctggcactgttttctaggtaagaggctggaggccaaggaagaagggggctcaaactccttcaacgatggcagtgacttcccagtgccagtcagcaagcaccccgtgctgactgcggagcagtgatgtccctgtcacagtgggccagtgaggccagtgtcatgggatgttactaatgtgtttgacatcacacagctaggaagcatcagagcctggtccagccctggtccctgtcacactgcctctgtgtgtgtgtgtcagtcctggaggctgttccacatgcccacacacagatcttccccagtctgtcccatagctgcatggcaccgcatagcatacatggaccataatttatcaaatttcctctgggtggccatttagttttagaattcttactaataaatctttgctagccctacaaaaatggcaacttcatatagtttagcctaataaaaatgatgctgctacaacaattttttttcttttcttcttttttttttttttcagacagagtcttgctttgtcacccagggtggaatgcagtggcctgatgttggctcactgcaacctccacctcctgggttcaagcaattctcctgtctcagcctcccaagtagctgggactacaggtgccaaccaccatgcccggctgatttttgtgttttagtagagatggggcttcaccatgttggccaggctggtcttgaactcctgacttcaagtgatctacccgacttggcctcccagagtgctgggattacaggtgtgagccaccgtgcctagcctttctttttcttttttcttttctttttaagacagggtcttgctctgtcacccaggctggagtgcagtggtgcagtcagggctcactgcagcctcaacctcccaggcttgagcaatcctcccacctcagcctctcaaatcactgggactacatatgtgcaccatcacacctggctaatttttagagtttttgtagagacaggtctcactatgttgcctaagctgttctccaactcctactctcaagtgatcctccctattcggcctcccaaagtgctgggattacagatgtgagccaccgtgctcagtcagcaaatgttttacttaacaaacacatgttaagtgacaaatactctactcttctcagtgctttatcattagtaacttatgtaatccttggcaaaaccctttgaagtagatacggttattttcatcataaatcccatcttgcagatgaaaaaactgaggctcagaaagcttaagtaacttgaccaaggtcgcacaggtgacaagcgggagagctgagattttagccttcaacggtgaggatataagcacatgcctcaatgtccattgtccttgccattcatctacaggctcacakgctatgatgcagaagataaattcttggaagtggtcttgcaggttaacaggatgcatttaaattcagccrtcaccaaaggaccaggagctggtcagggactgtcctgctgcaaccctggccaagggaacgtgaccccccactaaccacccccactcccacccccacccccatcccttgccaatgaggcagctgcagctggtcagagcagagaggctggagcccacactgggctctttgtcttcggtgggaacccttcagcccccatggcycctctcaagggcccactgtsccagtaccagtggggcctcccgggggccasgcctggctgggaaacttgccacgttggcggccccttggctactctgycaactgggcatgcagaaaccactcaggaatcattcccactgaaaagactggcgaggtayaggtccatgtcgaaggggatgcagcagcccagatgtggctggagtccaggccccagcccaagcactgtgcacatcctcatagcccaggcctagctcttcagtcctstgccccaaccgcctcccacctctctgagaggccctgctgctgctgctgctactacttaggaaggagggagggaggaagggagggaggaaggttgttgctgctactacttaggaaggagggagggagggaggaaggaaggaaggarggaaggaaggaaggaaggaaggaaggaagttcctcccttctcaggcaaacttcagtgctctcaggacccacccctcaggagyctgccctggtgtgattcctccccccaggactctayagcactgcccagagcagaaggggcccagtccaggctccagagcaccttgcaaggggaagccacaccctcctctgaggactgaaaaccaagggacatagttctaggaatgaggaaataatgtttgccctgtccaggctctgaaccctgcaaggggctcttgagggctcctgcacccaccagaatgtgcagagaagaggtcccaggtgggagccgagagggggctgagggcagatccccaagagagaagtaattggtgtgagagaggatctcaatttcttcgtgtctaaaatggggaaactgcagcgccacttaccctgcctaggtgagacaaaccgtagaccctggtacccagactcgtcatttcccaggggatgctggagctcaccaagcccaggcccgggtcccaggtggaacagctccggaaaggcgtctgcagaatccctgctgccctgtccttgtgcccttggtcatccttcctccctcatccccggctgcatctgtgccctgcagtttgtttaaacagaaaatcccatagcaaaccttgagactgtgggggcctccttgggtgcagggcctgggggaaggatctctccctctatggggggaagactgggtgttgggctggagggcagtgtgctctggggtcagggctagtaacccggtgtctgctgacacagctccacttgggtgggggaaacagcttactctgaggaagagcrctggactgtgagctctgggcgagctgggtgcagaagagcgacttggagtgtttagtgagcgaatgagtacctgctgcagaactcagagcccagttccctctaaaggttgggacctggactgcatgacttttcaagaggggagtggaggggggcgtctccactcctcccctttgctcttcctcctcaccagggcaaaggggaaggggactcctgggagaaggggagacaggtgggcaaggaggggctattggaggctctgttcattcactcattcgttcgcgggaagggtagaacgctgtccccctgcggaactcttgtacccggcatttattaagcatctgctgtacgccagggcctgggccgagcgctttacgtgcgtgaactcatttcgtcatccccaggtcctaggaggccggcgggaggaatcccactttacagatgagaaagtcgagggacagggaggggcgggacatgcccgccgtgcagacccaggcttctgggagggagctcccagctcgtgatgatggggacggatccgccgaggagcgcggcggctcgagggggcgggaggagggcgtccctccaacagagggtctgcggcctggacggggggcggcggccgggaagggggtgggggaggggctgccccgggccccgggccccgcaatccccgcccggctgggcccggctcggaaagtcccgcgaagcccccgcccggccggcccagggcggcgcgaacaagcggccctttctgcgccggcggcccccggcagctggaccgcggcccgctggggcgcggacgtatccgagctggggcgggggcgggggcggggcggccgcgttgccaaggtgacccgggcgcgggaaggcggctccggctcgcgcgggccgggccgggcggcggcggcggcaccatgagcggccggaagcgcagcttcaccttcggggcctacggcgggtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatagtggcgcttatgcatgtgactggggctgcggggctactccgcctgtgtgtgcgcgcgtgtgtgtgcatgcgtgtgtgcgcaactgctcacatgtataggtatgtgggagtaggggcaggcaggtcagggggaggttctgctggacctcccactttgcctctgcagctgttgggcccctcagtgacgctctggataaagggactctagaagcccttagcaggtcctgcccaccctgggcaccaggctgccctccttcctgcatcctggctctcaggaacctcctcctccctgggccactggctgcctgggcttggaggcctggaggaggtcagagtggcagcaggttcatcttggggtcaaggggtgcagaggtgggatggggatttatgcctgttgcggagatttggcaaattggagggacgatgggttagacagagtgggctcagagcccctgcccagccagacaagcggctccatgaccttcaccaggccctacctcccagtggtcatagggacccatgggacccaccttggggtgtggagcgctggggcttgtgtgtgggcatggtcagtgttctctgagctatggggattgtgtccaagctgccttccccttgtggacgctcaacttctgaggtgaccccagcagagggtggggtggggtgggaggccagaggctacccttccatatggggtcttgctagctgtcaggtgatgagaggagcctrggctaggccctgagcttcctggccagccaacacgggcagctcacaggctgggtcstgttctatgaccttgggcaagtcctggcttctctgacctcactgtctgcagagtcggccttccccatcagstgtccctgggagcccccagccctgccctgcggaggacgtcctcttgctggcagagttgggctgggctccctcctcatccccttcttacctctgggcaggaggcgagttgtttgttgtcccaacagctgctcagcccctgcccccagcggcaccaaggtgccctcagagggcagtaggagaatcygggcggrgcgggagtgctacccacacatgcgtcctggggctggatctgggtggatttgggggagacaaagtctggggtacccctgaagtcttagggagcagggtacgtgtgttggggtgagggtgggggraagctcctcctaratctcctcccagattcgcagacatttgcttcctgggtggatatgagtgaacagcttcaggattgaggcaggctacgggccttgggggtgatgttctttctgcccaccataaaccatagatatccagcaaacttccatcctgcctagaaaggctctaagctagccccagccgcacccctacatccttgccatgatccaagctgctgtagtcactgtcctactccacctgtccccccacccctgctaacaccccacagccctgccccctgccccactgcccccagtcctgcctcttttcctggctctttaacccctatgccttcccatgtccctaatctgacagtcaggcgactgcagcctaagggtgatagtgactgcatcaggcatccttagraacaggaccttctccagcccctctgggagggtggtgcagtgcaggtgggtgtgatatgctgggccaagctggtgagaagggatgtcccctcacctatggcccctcttgttgtgtttcagggtggacaagtccttcacttctcgccggagtgtgtggtgagtactggggactctcaggagggcctgggtttccttggctggtccctgcagatacccccaatccattcctacccctgcgatgccaggccagaccttaccaagcttccaaccatcctctcagggcaagggggtgggcagaccctcttactgtccccagagtacttttttagagagccttggaggcaggcaaagcaggtttacatcttcactctgccactgcctgtgtgaacttcagcaattccttaatgtctctgaacctcaattttctcatctgtgaaatggggattaaaatgcctattcatagggtgtaaggtaaaaagaacaaaamcaaaaactggccctggcatattttaggccctttttgcttaaatgcttccttccttttttttcttctctatttcttcccacctcagggtggcccctcgctgggctggggctcccttagcctttactgacccccaaatcctctagttactccccccgacagccctcagaaccccttcctcccatatttcctgtgtctggggctgccctctctttggaggaggagggaacgaggcaactgtatgtgcagcttctcaacaccaagaggcaatgggtggaggtgcagcctcacctcgggatacatcgtggcaccctgatgccccagcaggcaggtgcctccgggcttccctggcatcagcatcacgtgggcctggctggctgctcctgctgctgcttcacctccagcaggagagccccccgacggctctggctgstgcttcstgcccctgctcagggctgtctggggtccgtgggtcctgcagtaccccccagctgctgggcgactcccatctggcaccatcgtccccgcagagccctcctgggaagccaggcctggggtgggaggcacacagggtgcctcagctaagctcccagcctgcctttmtatttccctttgatgctctccatgcaacctcaggstgcttcctctccctttstgggcatcatctcctgctgctgtgcctagtccatttgagcccctccttctgcaagatggtgtgctatgctcagagcaggggtagactgagsggggataaaagcagaggtgaggaagatgccatcctttccttcagggagttcagtaataacaccactgacaactgccacttgttgggcacctgctatgcactgggtactgtagtagacgcctgacgtgttatctcatgtaactctggccacacctcagagttagggactattatctctaattacagatgagaacaatgaagcccggagtggggaaatgagttgcccaaggtcacacaagcagttgggatttgaaccttgatcttccagactctgtgcagagcccaaaacctcgcctactctgtcccagggccaccaggccacagggagggtctgaacgaaggatgcrcttgagggaagactcagagacaggggccacccagaaggcccaccccagggagccctaagccaagagttagagacgagggcccaggactgattgtaactggccagctgtgtgactttgggcgagtcccatcccctctctgggcttcagttgacccgtctatcaagtaaagatcggccattccccaggacacgccccattacccaaaatgccttgcccgtgctcgcctagctggagccgctgtccaaggtgctaaccctaggccctcccttcccagctgccaaaggccatcgcttaactccagcccatgcgtcagtggtggccattttgaccattaatcatgatctcctggcattcaagggctgtctccacctccttttctagtttggggcttgcttctcccgtgctctgtgtttctgatcaacgggaacatggcccagtcagcatcacctccccttgatgtccctccacttccatttccacaggccctcgccacacctccagcccaactttgtcaccatttgttgggtgttttctttcttgatccccacacccccattccctctttagaatgcctcctctgctgctacagagcatgcattcgtgaatgttcctggggtaggggaaaragcatggcaggtgtggacttgagtctgacaggtgtggacttgaatctgcctctgccacattctagttgtgtgactttggcaagtcattttccctctctgggctgcacttgctgctcaacatgtgcttgttgaatagggcatttccgggagctgacttcaggtgagctgcatgtgttcacataaccctgcagtgcaaagcaggctctgaactccttgaaaggagaggtgcttggtcgctttttgtttttttggagacagggtctcactctgtcgcccaggctgtagtgtagttgtgcagtctcggctcactgcaacctycacctcctgggttcaagtgaatctcttgcctcagcctcctgagtagttgggaccacaggtgcatgccatcactcctgggtaattatttttgtatttttagtagagacaaggtctcaccatgttggccagtcaggtctcgaactcctgagctcaagtgatcctcccatctcggcctcccattgagtcacatttgagctcaacttagcccccactttctcccataaaggccaggctgtacttttctcatgtctctgtcctccacatggtcttgtgcaactaccatgcccataaatgcttaatgcttgtggaattgaattgagtgtgttcagggaggggaataagtaaaaccttgtcagtaggctgggaaggcttcctagaggaggtgattttcccccacccctttacaaaacaggattaagaggttaggacttggattaaaggagcagtgagtcctggtagaggccagatgtgatcatggctgagttcccctacacatccctaacccctctcagcaggttgtctgcagtggaggacctcagagtaggtgtgcagatgcaagaggaaggaggcccagtgtgagggttgggagccagtgggacagtgggtgactgattatgcagccctaagggacccagatatcctagaatgggggctggacatttaaagtgtattcaaatggatggtgggaggtagagaggtgtcagggtagaggaatggtcaagtggacttgtgcaaggtaggagcgttctgaaaatacctctgggaagaggagagtcaactttggccttaaaactaggagcctgggaggtggaggcagaacccagaaaggattaagagctgacagcatgccaggcattttactctgaaggtctcattaaatcatggcatcagtcctgcaatttggcctgttgttgccagtttagaggccaaaaccaggactgagagtggtggaggctctggctcaaagtcacagctggtgaaggctggatttgaatccagctcttctgctgaggaagggacctaggtcagagacagtgaagctgcagaaatggggaaggtcttggttatgagttaagggaggagcggggagtgatgtagccctgaatgccacccaaacgggagtcactgctcagtccatgtgtcctgctgggaaggcccatctgggtgctgagatgtttcctcttgacagaattggtaccagtctctcccatatatggagcacttcctgtatcccaggccctgggcccagcacttcccctgaatcatttcattccatcctgacaccagccttacagatgactgtttgtcccttactactgtccatccccattttacagatgagggaactgacgctcagagaggggaagtggtggcccaggggcatgcagtcagtgaggggtgaaccaagaytgacagtaatgccactctgagcccatgcctttagccctcgatctcctggatgctgcttgtgctgagtggtgggctggggtgggtggccctgtcctcaggtggctccttatggcagtcactgagccagaggccctggggcctgtgtgctgctgcaggaagcacaaggctggcctcattagtggctctgaaatgccaagcaggcacagcccgctgggcctcctcatctattatgcatctggtgggcaggcccccgacgggcagctggcagtgtatgggatgggggagctagcagctgcttcctgagcccatggccgccactatacctctgggcagggatctcccaaggcaaatgccaaggcctcctgcctcatccccttggccaagccagggtgagggggttctactggggacaggggcatggatgctagtccccagctcattagcctggctatcctagcagccacttctctttattttattttatttttatttttatttttattttttgagacagggtctcactctgtcacccatgctggagtgcagtggggcaatctcagctcactacagcctcgacctcctgggctcaagcgatcctcctccctcagcctcccaaagtgctaggattacaagcgtgagccaccatgcccagcccctggcagccacttctaagagaggctgagacttcgattgagctgggggtcatttgggaccagaatgggcagaggtgggctgaaatagaatcttagatgcccaagctcctggctgtacagagcctcagagcgatagagctgtggtcatttgttcatcatttattcatccagccacagtaaccactgaacacgtactgtaggccaggcatggttttagttactgcagattcagcagaaaatgagacaggcctagccgctatactcagagagcttggtttgggcagtacttcacctcactgagcctggatttcctcaactgtaaaattgggaatggcggaggcagactataagtaaatagacaaggaaacaacctctgatgggtacactgaatttctttctttctttcttttctctyttttttttttttttttttgagacagggtctcactctgttacccaggctggggtgcagtggcgcgatctcggttcactgcaacctccacctccgtggttcaagcaattctctgcctcagcctcctgagtagctgggattacaggcgcctgccaccacacccggctaatttttttgtgtatttttagtagagatggggtttcaccatcttggccaggctggtttcgagctcctgaccttgtgatcctcctgccttggcctcccaaagtgctgggattatagacgtgagccaccgcgcccggccaggtccactgaatttcaaagcaaggttacatgctaacaagagctggtccttgccgagagctgagcgcgtgccaggctgtgtttcagagcactttgcccacgttcatgggtttgatcttcacaacagccctgtgaggcaagaccgttatgaaccctggtttagggctggggaggctgaggcaaagagaggttaagtaacctgttcaaggtcccttggcaaagctgagattggagcttaagtagccaggctccagtttgcttgtcaccctgcgctgtatggctggaaaatgaaggagtcctggaaagcctttctgaagagggggtgtttgaaccaaaacctgaaggatgagaggagctggccatgggggagctggcagggtgtccagacagagggagcagcaggtgcaaaggctctgaggcagggatgagcctagtgccagagagacgccctgcttccaggaaggatcctctatagcttcaggagacaagagaaaaatcccctccacatgcgttgtggctctgggactgccactgtttggctgtgtgatcttgagaaatgggtccccatctcacttgtgcacaactctgctatcccacgtctatcctcagcatcatgaagagaggactcttgccgccctgaggtccctggtctggttggccctgtgtgcccctatctcctggtgatgctcaaactctggtctatttgtctgagatgcatgggaatatttgagttctgttaggtagacctgagttcaaatacccagttcaacttccacttacttgctgtgtggccttaccccaactactctgcctctctgaaccccagattgtccataacaatggaaacagtattgcttcgaatgaaatgagtgcagagtgtatgcgcagggggatgttctcccttctaactaagcatttgcattttgagaggaaagactcattcatccaaagagagattctctagtgatagaattttaggcactgtcgtggccacagggggtgagtagatggctaaggaggggattttctttttttcttttttctttttttttttttttttttgagacggagtcttgctgtctcgcccaggctggagtgcagtggcacgatcttggctcactgcaacctccacctgccaggttcaagcattctcctgcctcagcctcctgagtagctgggattacaggcgtgtgccaccatgcccagctaatttttgtatttttagtagagatggggtttcaccatgttggtcaggctggtctcgaactcctgacctcatgatccgcccgtctcggcctcccaaggtgctaggattacaggcgtgagccaccacacccagcctcggaggggattttctgatagcccagatcctggaaaggccttctgagttcaggatcttccccaaaattcattcattcagcaaactaattcaataagcatttagtgtggggacaccctcctagggccaaaccctgtgctgggcgttggggactgtggtggagaaaatagatgaggccacttcttctgggttcagagtctagagagggtcataaggaaagaggtggtttgatgggaatgacatgtgctgactagggagatgtgagggttgctgagatctcagagaagggactcctgcccacatctgggaatcaaggagggcttcctggaggaggtgactcaaaagttgaagtgggccaagtggcagtgtgtgtgtgtgtgtgtgtgtgtgtgtgtgtgtgtgtgtagtggggaagggaggtgcactgtgcgagaatgttccagggacaggaggtggcaggtcagcaatgtggaggagaaaagtgtgtggtggcacatgctggattcaagactgagttgggcctgacaggtgaagggaagagagacagccaccagatcatgtccctgyaggccctgctgggacttctgtgggctacgctggaaggctctgaaccccccagccaccatgggaagaggcctgctagggtgccagtcgcccatcctcctccctgctccaaggagctgctgtgtgagactgagtcagccgcagctcagggaggccctgactgtgctcttagtgcagggctgtggaagccctggagccagagtctgggctgggaccgcagatgctgtctcggccaccagctggctgggtgacttctctggatctcagtttcctcacctgtaacatgagggcaataaaagtactacctggaagattggtggggggattaaatgagataatgggtgccaaggcctgaaaccagggcctggcacagagcacgtactccgtcgatgccagctattgcggttactgccatcatcgcggtcatggttacctgctgcgccygcagtgggtgcggaattgcgcttggtgtgtagactctgtcctctggaagcttgctgcctgccagggggtgacctgactgcctacacgtgactgtacaccccagccrtgggcactggccttaggcactggccctgagaacactggctttggagtctgatgggcctggtgccaggtcctggccagtgaccttgaggagtccgtcaccttgctgagccttggctcattcctttgtgcagtgggggtgttcatggcccctgcctcacggtgagtgagaggcagtgaggaggtgcttttaaagggccggccggtgtaacaatgcagctgtttctgaccccatgctgcaggagggaagaaacacatgcctcggacccaagtgacctagagaaacatcaccctccctctcagaggctcattttcatacctatgaaatgggaaggttggctgtgatacactctgatgtgctggggttctagtggagttagcttgtccctaagtttgacctggtccagctgtttgctgtgtgacattgggctagagacttaacctctctgaacctcagtttccatgcctgcaaacgggcaatgttcacctcctgggatctttcagggcttccattagccactcgttaattcaacaaatacttacggagttcctaccacatgccaggtactagtctaagaactggggatgcagcagtgaacctgacagacacggtccttgcttcacgcatgttatcctccagtgcaggagacagacagctaaggtagcttcagatgggtaatgtgtagtacggatggggtgggtgcaaggcctggctttgycaagggtatcagggaggggcctctctgaggcctgaatgggaaggagctggctgtgggaagagtagtccaggcagagggtagagaaaatgtaaaggattgggggcaggaataggactccttcccccgccccaaagctggaacattccagatcatctcctggcaacaggtggaggtggctgagaaggcagagaggctggaagcccacttctttcagatcaggaactgctccccagtcaggtgtggtggctcatgcctgtaatcctagcactctggggaggccgaggtgggtggatcaccagaggtcaggagtttgagaccagcctggccaacatggtgaaaccctatctttactaaaaatacaaaaaaaaaaaaaaaaattagctgggcgtagtggtgcatgcctgtgatcccagctactcaggagactgaggcaggagaatcgcttgaacccaggaggtggagattaccatgagccgagatcacaccaccgcactccagcctggccaacagagcaaggctccatcccacacacacacaaaaaataactgctgcccacaagacaggcccggtggggtggtggggagtgtgggcagccatggaagaccaggcttggcttgagtctcaagtgagctgggctgtgcaggcaggaggctgggctccaacctgtaggagcaggcaggggtggagctcactgcagggcagagtcaggcctccagcctggagcccacctgactggatctacctggcgcaaagaccctggacctattttagtcgggggtaagggaactgctgcttgttctcccctcaccccagccagcctaggcactggccccaggttgccttggcctttcccagcccagctgcctgcaggctgaggaaaggttctttgagatgacccattacatgtacacacacacatatttccctactcacactcatagacttgacccttgtagagacagcttcatcatgaacatagaggcacagacatacacattcattcatgcagcagatcagacccaaacagacccaggcatgacctgaagaaaccccatttctagcaggagagactgacagtggcttaatggtcacacyatgaaatgtgcaaacgmaacaggtaaatccatgaaggcccaagacaggcttctgggaaagctggtcaggttcggagcagcttctcctggtctggggagggggctctggaagactgaatacagacatagcacctgaaatgtgatccaagcggacgggaagggggtaacasgcagggggcacagcgtgtgcastggcctggaggtgggaaggagcacctcgggtttgaggagcggaaaggagtctggagaaggaggaaagaagccctggatgaggccagagacastgggcgggtgggaggggggccggggatggggagcasacacgcasggcctcgtgggccacgtgaggcgggcgtctggatcctgcttgcggcgggaagccattggggccttctakgcaggtgggtggtgtgatcagatccaaacatgcgacacaagcgctttccctcccacacccattcacgctcctgccggggcctcccatctccattctcacccacagagtcacacacaccctctcgcaccaccaggcagagctgcggaacacccggtgccgactcccaggaaaagtgtcagacgctgccccgcccaccggctgagtctgtgcggcagggccctggggtccagccagggtggatccttgctcactccacatccgcacagatgtgcctgtgccccccgcctgcccccacaggagtgaggtcataactcttctctacacgtgcaaggtggcttctagcttaggacgtactttcacgtgcattctctcatttaatgctctcagcagccctgcagggagaaattctcaacaccattttatagccgaggaaacagaggctgagagaggtgaagggactctccctaggccacacagctagagcttggcacaggcaggatttgaactcagttccgtttgactttcaggtcttgttctctggcccatccagactcagacacactcaggtgtgactgtcacctttccaggctgtcactgagaaggtgacaagtgaccttcaatgccaaatccatccacaaacaggttgatcaacacagaaagttatttagagctccagggaagggcctgggctgggacgtgcccacctgcctggtgaccctgaggcttctgggggtagtgccaggggtggggctgggcacctgccagcctggggcagctcagggcatggagcccgcgctaggagcagagcctacatttgcatttacaaatgaagtagacagccctgtccccacacatgctaacccggctggcctggcttgcaggacgtgacagctgaagtcacagggcacatccctgggcccagctgcctgggccacttctgtgctgcctctgctcttccctgaccctcggagcaggttgtctaatgcctaatgtaggggaaagagtgtgggcttgggagccagccagaatgggggtgcaacccagctctgtgacgcctggctcagggacattggtcatggtgtttagtctcttttcgtgtcagcttctcccccttggaataaggggtgagtcatacctccctctcaaggtgatggaaaagggtaaagcagtcaggtgctcagggagctgagtcatagtgagtgctcagctctctaaaatctttaatttttttctgattacacaaatactaagtgttcattataaacatccaaaccgtgcagaaaagtatttgccacagaaagcagaagttcctagtggtcctgcttctcagagataagccatgtaaactttctttttgtttttgtttttgtttaaagagaaagaggacggacagacagacacagcccaactgggcttcatcccactcaaaattctgagggcttttgggcctcagggtcccatacgcagcaagccccttttctctctctcttttttttttttttttgagacagagtcttgctctgtcgcccaggctggagtgcagtggtgcaatcttggttcactgcaacctctgcctcctgggttcaagcgattctcctgcctcagcctcttgagtagctgggattacaagcatgcgctaccatgtccggctrattttgtatttttaatagagatggggtttcaccatgttggtcaggctggtctgaaactcctgacctcaagtgatccacctgacttggcctcccaaagtgctgagattataggtgtgagccaccatgcccggcctttttttcttttcttttttttttttttaataggatcttgctctgttactcaggctgaagtacagtggtgcaatgttggcccactgaagcctcaacctctcaggctcaatcagtyttcccacctcagcctcctgagtagctgggactacaggcatgcaccaccatacccggctaatttttgkggttttttttttttttttttttggtagagatggggttttgctatgttgcccaggatggtcttgaactcctggctccaagagatccgcctgccttggcctcccaaagtgctaggattacaggcgtgaaccaccactcccggccagccatgtaaactttgacatgtaattttaaatttttacaaatgagatttttgttgtgtgcagcccgctttattcacttaacaatatgcctcaaacccccttttccatcaagactaaagaccttctttgtcattgctgtatagtattccatggtttgatatatttaactaatctccttgtaatggacattgaagtggcgtccagatgtttgcrgttgcaaaccctgcttcatgacttttttgttcatatatctttatgcattggtgttatatttctggagaataaatgcctagaaatggggttgctggaccaaagaatatgcacattttaacatccattgcctctgccctcagttacagggatcctagagtcatcaagaggcaaagaattccagatgtggggctggatgcagtggctcactcctgtaatcccagcactttgggaggctgaggcaggtggatcacttggatccaggagttcagaccagcttgggcaacatggtgaaaccctgtctctacaaaaaaaaaaaattagccggatgtggtggcatgcacctgtggtcccagctacttgggaggctgaggtgggaggcttgctggagcccaggaggcagaagttggaatgagctgagatctcaccactgcactccaccctgggcgacaaagtgagaccctgcccccaaccaccaccaaaaaaaaaaaaaaaaargaaaaaaaagaatttcaaatgtgggaggcaccttgaggtcctccagtcaaaccccccaccgctcctcccgttcccacaccttcagatctccctggctgcacctctgagaagctcactctgcctttgcttgatgcagagctcggtaccttacatggcaggttgctcaggttgctttcccttcctccctccctccctcccttccttcctccctccctccctccctccctcccttccttccttccctccttccttccttctttccttccttccttttccctcctcctcctcctcctccttcttcttcttcttcctttctctctctttctttctttctatttgagatggaattttgctcttgttgcccaggctggagtgcaatggcatgatctcggctcactgcaacctccatctcccgggttcaagtgattctcctgcctcagcctcccgggtagctgggattacaggcgtgcgctaccacacccggctaatttttgtatttttagtagagatggggtttctccacgttggtcaggctggtctcaaactcccgacctcaggtgatccgcctgcctcagcctcccagagtgctgggattataggcatgagccaccatgccctgcctaggttgctttactcttgggcagctgtgtttgtcccatcgtttctaccttctcacaacttccacctaggagtcttgtctcagtcctcaggcacctacagaggaaggaagaaaggaaggaagagaagggaaggccaagaaatgctcatggtgaatgttaagcactttacaccaatgaactcatttaaccctcagaggtcagcactgctatccccattttatagatgaggaagctgaggttcatagtggttaagtaacttgtccaaggtcacacagctgttatgtggcagagttaggattcgcactcaaggatctggctccagagcccacactgacgctacactgcctctctaggcaggagcctgtaatttattgagcacctactgtgtcctcagctctaggctagtcaggttgtccatataatacctaatttattccacacaacaaccctgcaaagttggtgttactctcccattttgtagctgaggaaactgaggctcagagaagagaagcgacttagaagagtctaaggtcctctccactgggaaagccctccttcagggttctgcttccaaccaatccttggtgaactcagtttccagtttctcatcctcccattcgtcctctgtaggatgagagagccggcctgagacccaatttttagtagagaaactgaggcttggagaggttatggtgacttaatcctgcacacactgtgatctgggggcagagctagggcttccccatgtcacstttggttaggagatggtgaccttgtctatccccgtgggggtttcgccttggcctgggtggtcaccccgcctggggagttgtgaggggcagggacttctgctcaccagactggcctggagcctatgaggcagcaaccccagccccagctagggctggtgcagagcgggaggaaaggattaagcaaggcctcagtgctgggggactcactgtctaggcagtgaagccagaggctcctcaggaacagtccaggcaggtatctttggggctctgctttgggactggggaggcctggttcaccccactctgatcccagcacccagcaccattgtccactccagagcagacctcaggacatgtgttytgaatgaatgactgagcagaggaatgaagggcagatgggggagtgggtagatgaccgagtgggtgagtgagcgaaggaatgcctggagctcagagaagggagaccccctgggctgcggaggctggggagggacaatgaggtcaatgtagggagtgaggagagacagaaagcataggcggctgtaataccatgtatgggctgacgggtgctgggaaggtcaccctggcccagacttgcccatcagtgggagctgtgtcctgcgtggacgtgggcagggggcagagcagctggggctgagcttcggggtggaagcttggaagtcaccatctccatccaggctccagttttcttccaggcagaatggagattagcattactgctctgtgttcctcaggaggctgttgagagggttgatggcaaaggcagtttgtaaactggaaagtgccaggctagggaagcagatgatgttgttgcccggcaggaagaggccctgcggccgggtcatctcagagtcactcctcctccttaccccagtgcaggggaggagtcagtccacactgaagtcctcggtggggtgggaagggtcaggttttggccacagtggggctcaggccacctgagcaagggagacagatgctggatagacagcaggtaaatgggtggcctggttcccagatgctgtgccctgggcagggaccggtcccgtgaccacctctctaggctgccaacctgttatttgttcaggaggcctctgcctggcccagctccgggatccgggtgtctcggcatgcagccagcatggggcgagggtggcrgccccatgtgccaccttcctgcccatccctctgcccagcttggggcctgagtctcccacccacacccccagggggaccctgccagctctgtcacttggtagctgttgaggcccttggcccatcataaacctcactaagcctctgcctccttatctctgaaatgggtgaagatagcatcctgaggtcagggttgttgtcataaggattgaatgacatcacagtgcccgcatggcaaatagtccccctgccgctcctctaccccatcgccacgytccctytakagtcctaggagaggtcaacggtgcccagggaaaggggacacaggagcctcccgtgcctgtgcctgtctgcttaggctcccagtgggctggggaagagggggccagcctctccagacctagctttggaaacctgctcaactggctgccccggccaccttccctggcactttggcagggacaggggcaagccaaggggagggcagtgccggctggttgagctcagaaaacaatgggcttctgtggcccccccccccccccgggagggggcagttctggggcagccacttggttctggtttcaggagattcgagtcccctcagacccgatgcccagggctaggagacccggctctggcagccccccagccctcatccaaaggagcctctctcagggttgccctccacagccctcttctcactgggaggtctgtgcccttgtcctcatcctccaccccacatgggtggtagaacttggtagaaccaggttgatctcctggaaaccaggaagaccccagggaactggacccaggccttcccctcctgacttctgatgaccagtgctggactggccggaacccctcaggcccctgttccaggctgctgcccccaaaaaattcttctctgccctgtattcattggctccctgaacccctcccccgcccttccagaccactccctctttccgtgtccggtctcccagcctgtgtgcagtgggtggctgtcctcagggtgggctcctcctgctcttgctccaggcactgtcacckgtccagatcccyattcccctgctcccggtcccagccttcttgccttgatggtcctgtaccacctgccctggccaccagagtttcacctggttgagttgaatttcaaagcatcaatggttcactaggcagaaaagcaggagaaggcacccccagcagagggggggtgcctgtgaacagtgtggctggttaggaaagctgcctgcagcctggggaggttaggacagagccaggacaggcggctggggcaggacaggaaaggggaggtatgaggttgaggctggagggagtcagcaggggctggacccactgggagaccaccatccagggcagctatctccggggggccaaagggccaagcccaccacccaggacagccccaccacacttctggtgccctgaaaaggttgggctctccaggagagtggccagtaataataattacaagcactttatagcaactctatgaggtgggtacattatctctcattttgcagatgagagaaaaagacaggaccctctcaccacccctccagctggttaacagttgagaatcaccctaggaaggcatctggccacctgtgcttggtctccccctctgcccaaccattcctgagtctgaccctgatgttttgttggtctgtttccattgtatagatggggtcttgctctgtcgccagggctggaatgcagtggtaccatcatggctcactgtagcctggaacttctggctcaagtgatcctcccacctcagcctcctgagtgcctgagactataggtstgagccactgcagtgggctgggtttttaatttttttgtaaagatgagggctcactttgctgcccaggctggtctcgaacccctggcttcaagtgttcctcccacctcagcctaccaaagtgctgggattacagrcatgaaccactgagcctgggctgaccctgctgttttgcagagtatggaactctcttgagatcttcccaccctggactggtggaaggcctgtgttcttatccctgatctgctgctcamggccttattggctgactttgaggtcgtgttttcacctctccaagcctcagtttgcccygctggcaattggggatcctagtgactgccttatctccattccagttccggtgagagtcccaggagtgagcagataaagaaggcttttgaaaagtacaaagaactgcactcacgatggtgcgattattattgttacctcgatgcagagataagggagggggaggaggtgcastgacagttgccaagaaaccggggagctgtcagcagcggcttccggccgggcccatcccacttaggagctgggcccttcccccacacccttgcttcaccctttccctggaaaagatgggtgctctccccgagagggagagatagctgccacacagacacaggggctgaaggtgaccccggaatgtgcctggcccagactccaggttggctccagctttccatgtgaccttgggcgggtcacctcctctctggctgctcccatttcatgtgtcagaggaggcagcgtgcaggtgtccaggccagacagagcagagccggagctgggcctakggaaggcgcttggcggtggctgcasgagccasggccgtgatgggaggtcatggggcasgaggccasgtgacgggactgagggcctgggctgaggacagtgggatgcacgctgtggaagggacactggactggagtcacatctcagccctgccctttcccattgtgcgacctggggcttgtcactgaacctctctgagcctcagttttctcatctggaaaaaaggtttatatctcatctggatttcttttttgttttttgtttttgtttttgttttttgagacagagttttgctcttgttgcccaggctggagtgcaatggcgcaatctcggctcactgcaacctccgcctccygggttcaagcgattctcctgcctcagcctcccaagtagctaggattacaggcgcgtggcactactctcagctaatttttgtatttttagcagagatggggtttcgccatgtaggccaggttggtcacgaactcctggcctcaggcgatccacccgcctcagcctcccaaagtgctgggattacaggtgtgagccaccgtgcccagcctcatctggatttttaataagttgctgtggctctggaatgagacaatgccagtgtaagctccagggtgctgcacagatgtgaccacggtcatggcagggggaaggaggagaggggagagcgccccatgtcccggcatgctctgggctcccsgcagctgctgccgcccaggaggaatgcaaagcattttaagctgagccaggccagggggttggatggtttttggagacgtggggaagggatagagaccagggggacatccatgatgtgaactgaatggagaagaccaggaggagaccagggtgggataggagagagaaggggagggacagagaggttcgggttcgtgaagtgggaggaaacgaccacattgtgggtggtctgcagaggccagaggaagaaggggattggaggggtgctgggaaaggtggggcagagatgggcgagctggtgaggaaggctgagcaggaaaggacgtgaagcagagaagggcagagggctggtgaggagggaagaggctttcattcattgcttcaaaagtatttattggggccaggtgcagtggcttatgcctgtaatcctagtgctttgggaggccaaggtgggaggcttatttgaggccaggagttccagaccagcctgggcaacacagcaagacacscatctcaacaacaacaacaaaaaatttatttttaattagccgagcacacacctgtagtcccagctactaggaggccgagggggaaggatcacttgagcccagcagttcaaggctgcagtgagccatgatcatgccactgcactccagcttgggtgacagagcaagaccccatttcttaacaacaacaaaaggtcaggggcagtggttcattcctgtgatcgcagcactttgggaggctgaggtgggaggatctcttgagcccggaagttccagaccagcctgggtaacatagggagacctcatctctactaaaattagctgggcatggtggtgcctgtagtcccagcaacttgggaggctgaggagggaggatggcttgagcctaggagtttaaggctgcagtgagctttgatcacgccactgcacaccagcctgggcagcaagagcaagatcctgtctcaaaaaacaaaaaaaaaaaagggaaaaagaaaaaagtatttattgagcaactactatttactaagtgtcagtggtatagtgttaagggcactgcaaccagatgttgggggaggtmaaatcttcagactttcatttactgtgtgtgaccttggacaagttacttaacctctctgtgtcttagttccctcctttgaaaaatgcaaattaaatgagttaatacaataaagtagagcagagcctgcacatagtaagctctgtatcagctgtgtcggccgttgctgttgttactattacctttccgacttgacttgaggtgctggatcgtgttcctgagctggaagtcgtaaggctctgtggggaggtccacaggattggacgtacatgttataaagttcagatcttgggctctgaagtcaacaaacctgtgtccaaatgcctggcctgcctcattgcctgtgtgagcttgggcaagttaacgcacctttctgagcttcgtgtggaaagcaggaggtttctgaacatctgcctctttggggaactgtgaggattaaattagattatgcaagacgcccggcaggacgtggctttgtcattcctgtccctcttctaccccttcaggtctggggatggatggacaggcagtgcccagagcctccagtttccttctctgtccccatcctggagcccctcccttcccctgccccttacggcctcagcagtggctttttasgtggagttgccttcgggggacaggactgtggccagccaggaactggagagccaagggccctgggatggggtcccaggtgcaagccagagcaccctggccttcagaggccgctctggttctgcacccacatgagcaatcctgagtgaaatggacacctacacatggggagactgaggcagagagggttctggaagggggtttgtcagggactgctgcatggctatcatatgagcctaggggaagacagaagggcaccgctggactagcctgatcacaagcaacagccgccactgggcagccacggcsgcacccagcactccagctttaccgggcttctaccccaggacttcctgacccccaggcagcctctgccctccaccccactgcaggatccctacttcctctagggcatgtactttaaattccagctccatcccccattcgctaggggaagtggcttcacctctctgagcttcagcttctccatctgtgaaaatggagagaaataacaccaaccttcctgcacagtagttgggggagagtatatgcttgacgcagtcccagtcacatagtaggtctcactaaagagtccccatgggagcctcagtggaattgcctggaagccaccctccctcccttcctcccttcccccctcctttttttttttctgaggtggagtctccctctggagcccaggctggagtgcagtggtgtgatctcagctcactgcaaactctgcctcccaggttcaagcaattctcctgcctcagcctcccaagtagctggggttataggtgcccaccactgtgcccagctaatttttgtattttttttatttgagatggagtctcactctgtcgccaggctggagtgcagtggcgcaatttcagctcactgcaacctccgcctcccgggttcaagcgattctcctgcctcagcctcccaagtagctgggactataggcgtgcaccaccatgcccagttaatttttgcatttttagtagagacggggtttcaccatgttggccaggatgttctcgggatctcttgacctcatgatctgcccacctcggcctcccaaagtgctgggattacaggtgtgagccaccacgcccagcctgtattttttttttttttttttttttttttttttagtagagatggggtttcaccatattggccatggttggccaggctggtcttgaactgctgacctcaggtgatctgcccgccttggcctcccaaagtgctgggattacaggtgtgagccatcacgcccagcctgccggtaactatttctatggacctctctttagtccccaccctcccactccagactctccccatgtcagtgtaccctgcaatatgcaggaacctgtgygtagggatgttcctttgctcacaacccttcagtgactcccaaccttcattcattcattcagtcattcaacaaatagtgaaacttggggagccagagtttaccatgaacaaatgatgtgaaagttttcattgagtgaattcccatgagctgcccaggctctgcgatgaatgtktttggaaactgaggctgagagaggctgtgtcactaacccaagctcacctagccagtcagtgtctgagactatctcccccacactgatgccacaggcttgaaatgccactgccaccatatctgtccttttgggtcaagcattgcccagcgcasacccctcttgtaagatgccatcactcctgggaggtggagaggcctccrgtgcataagtggggctgtggatggttcctccgggccatttctcctgctggagtagctgggctgagtggaattagaagggaggctcagactgggcgcagtggctcacacctataatctcagcactttgggaggctgaggcgggcagatcacctgaggtcgggagttcgagaccagcctgaccaacatggagaaaccccgtctctactaaaaatacaaaattagccaggcatggtggcgcatgcctgcaatcctagctattcaggaggctgaggcaggagaatcgctcgaactcgggagacagaggttgcagtgagccgagatcaagccatttgcacgccagcctggggaataagagcgaaactctgtcataaaaaaaaaaaaaaaaaaaaaagaagaagggaggctcacagctttctcagtcttcttcctgggccagactttttcgggtccttcccctcttggggtgtggcagccccggctctgcctgactcaagcctgctgtaggccaccagcgatcatctgagtcaccctcgagggaccagcctctcttgatgggacctgagcagaggtgcagccacgtcagggtggccctaggcagcagcggaagccaggcctgcttgcccagccccaggatcccgggaaccactgggcatttcctctccctgccccagaggtggcctcggcaggctttttagggtgataggagctgacttcaccctcgccagacctgctttctttcctcagggaagggtgtggtgtgggcagagagtccgggcttagactcaggcaggtctcatgcagatgctagctttgctgccggccagccgtgtgacctctgtgcacagctgggtcctgtcygtaaagtgggaataccagtgtggtgaggaggccatgccctcgggcctagaacgagggctcagcacagggcctggcatgtggtaggcccaatgagcgtcagttatggtcacggtcactgtcattcgtaatagyggtagccctggtagcccctcaatgccaaggcggctactcccagaggctcagggaggggtccattgtagaggcgggggcaccctgcttagtccagaaagctcaccctccacagcaaccctcagtgcccctgcctcagtctactcatcttcagagtaggtcactgctyggctggaggcctaatggagagcttggggagagaccctgtccacgtctctgatctccggggaaggagaagcctgtgtggyagccctgctaatgaagccyctcctctccctcctcttggggaacccatgaccctctcctccgtgaagtctatcctccctcacatcccccagctctgagagtgactctcccagagttcccaaatttcctggcttggggctctccctgacctcagactctttctcttccaggaggagygatgggcagaaccagcacttccctcaggcactagacctgtcacgagtgaacttagttccctcctatactccttcactctaccmtaaggtaagtgtccccctccayacctacggcccctggtctgccccctacctccgacacatgcccagggctgggaaaggcccaagaatgacttttgggcaaaggtaaaatgttcaggcagatgctgatggggtttagctcctaaggggttgccactcctgagcccggggtgaggctggtgcagtcacaaacgttgaacctaggtctgtagactgtggcagggaggggcttagggcgaatctaagcaaaacagctgggaataaaccagccccccagctatyttcatcatctccacaatcaacgtcaccatcagtctccttatctgtaaaccaggtgcaatgagaggacccacttcacagggtcattgtgaagattgctgcaaagtacagacagggcggcccaggcacagcatccggcacagagcaagagccctgtcaacgagcctctatcattatcgttaaaatcaaacgtttgcccagtacctgcttcatgccaagccttgtgctgggtgccaagcgaccagaaaccaatctgatacagatcctgctctcaaggagccacagtccagtaaagcaatagataactgaacaatgtatgcaggacatcaaatagcagaaataacctctaatatttattgagacttactgtgtactaagagagtacttaatgctttatttgcagtatttcatctcatccttggactatgtgatagctactataatcagtcccattttgcagatgagaaaattgaggctcagagaggttcagtcacttgcccraagtcactcaggttggatgtggtggggccacgaccggatgcaagctgtctgaccagagggcctggtgttagggcctctctgatgcaggggtgacaagctctcacttttgcagtactttttgcagtttctaaagcacacccacagacatcatgccacctggtccttttagtaaaccttgggtagtaggcattatctagttgaggatgcaggagatcagagaagtaaagtggtcttcccaaggtcacacagccagaaaatagcagaggcaaaatccaccaggctcctccctgagagctctggcctggaataaaggccacgtaccttgcctaggctgggagggcagatggccaaggaatggtgtccatatgtggggccascaccttcatgggggtsccacgtggggctgctgggagcagcagcaggagattcctgagactgactcctgttttctctgtctgggcaacagcccaagaytggggcatgtggatccggggcttggcaggaagggagagactcaatggcagccctcacttgacagctgggttcatgaatgaagctcccagtccctcttcccctgagcatctcaggaggagccctgggttctcaccaagggctgtatgccctcggaccacagcttcccctccctgggcctcagtcttcccatcaggagacgagagagagagagagcagcccatagccctgggccctgcgtgctagacagcctggggttggccttctcggattattgaaaagctgcctcccctcgggcttcctggcttccacccagtctggctagaagcctccgtttgtgccaacacagctcagacagcgggctctgaaccttcccttcccgacagcccacccccacctcagaatcaagagtctgtggaccatcctcctttgacaggagaggaaaccaggggctagagagactgaatgattcatctggggtctccagcaagccagtgctgggctgagggaacacaggcctgtgacatattctccattcccctcccctggtgcccctagctctgtgcacatttataacatggatggcatccatctgaagggcaggtgaccttcctctgccagtgggcaaatccctgcccgtctctgggcctcaggttcctcatctgtaaaacagaggtgacagtttcttctctacctgccttgccagcttgcaattgggtgaaagtactttggaaagtagaaattaggaagctgagctcttatcagcgtcattacattcccagggctggacagggcacccaraagggacattctcctcccttcaggccccacatttgtacaggcatcgagctacccaggaccctccttccctcctccctacaggggtttctccactcggggattcagaaacctgcacacacgtacatacacagcctacccacacctacatatggggacagagtcacagacacaaaacacacagccacagccactggtctgtaaatatattcagagacttgcacatgcatgagatacacatgtacaaacacaaattcccataccaaggcattcccatacacacagaaagacagtatgcccacatacatacagccacatccggtcgtggagtctcacacacacgcacacatggctgcacgcatatgtgcacacaccttccatgccacctggcacacagccatctccagtgctgtgagcaggtctcgcctccccsgggggcagtgtgggaatggatgtttctctggctggatttcgatgggtgcccggaagcattcaggcctggaagtggctgcataaatcaatatttgctgttgttaattattaaaaccaaagctacaccgtgtctggaacacccatctccagagttcctgctggctctccaggcccaaacctgattcaaggccaggtctagggggaaagggagggcacagtgctttccttccaggagcccttagttctggggctggagggtggtgggcagccactggcagctctttcaggaagctgaacagaggtatggctctgagctggtgggcagccctgcccccgcaacatccaaagcagctgtgtctgcttggccacagttcaggaagcatttgctgtgttcccaacatctgtctggaggaagtggtagcaaggccctgtccctgtccctgctgtacagtggctataccaggccagggacacactgcagagccagctggaagggcctacagagtccttatattttaaagatggggaaactgaggtccagagaggaggcagggactcactcaaggccactcagcaagttgtagctagaatccacatgtcccaaaatctacttgggtcctttcctccataccacgggcctggcagcccctccctaggtgctgtggccatctcccccaggatctggggcagctagggcgggggaagggacggagcaggccagccactgtgaggcatgggaagcaggatggaggagaggaggaggaaaagggacagaccccaaagagyagcaccaggcctttctctggattccactttgacttcttcctgactgtgtggtctcgggcaagctatttcacctcytggaaccggcttctcatctgtataatggagatgacatttgtacctcctgggctgtgacgagattacgacacatgcgaagggcccagcattaagtaggtgctcaagaaaagccctctgtctgcaaggtaacccaaccctgtccttgatgccgaggcggggtacccagagcctgggaagatggagaaagtgaggtgggggcgcgctggggagaaccgagtggggggccccctcggggagcccgacgcacccaaagcttctagcgctcgggccggaacgcgcaggcgcggtgtcccggggccgcgggccgggccgcccggggggcgtggcttcagcgcccccgccccgccccgccccgcgccgtgccgcccgtacctggcgccccgccccctccgggccccgccgtggggcgagcccatcgcaggcagcgccgccgccgggagccgggagcgcggagctcagcgctgcggggcccggacccgggcgcgcgcgggccaggagccggctgggccagctgaagtgccgcccsggcgggggccgggccgggccgcgctcaggatggcacagctgcggcccgcggtgccacccggccgtccgcggaggggctcgctgcccgcgggggccagctggcaggtgaggacccgggcggggcggcatggcggagggaccccggggctgggtcaccccgactgctggggagcccggccggctctgccccagccagggcgggcggacaaggctccgtcatggtgggcgtgtgagcttctgggctgacactggccacggggcgcacccctaccctggggtcccggaccctggggctcttgctgtggcctcccgggtggcactgtggctctgggctgcagcggcagggtgtgtgtgggtgcgtgctaccgtcgggaccactttaccctgcccctgccccgtttggggggctctgaatgctccagggccactttgtggtggtgctttcatgtggggcaccccccatctggaccccatctctcagagccctcgcgtgtgtcagggcgtctgctgctccctctgaggctgtagctgtgggtgttgcttgttgctgtgtgtacactctgggtgacaggaccatgtgtcagtgtttatgtgactgattcccaatgcaacaaggtgtattagagtgttcctggctacgtttggtcaccctgagtggggtgtcttaatgggggacattaatgcacccatcatcagtgtgactctttggggtcatgcccagctgaggttgtgtggctgacctgggcacagaagccaaagttgctgtcatacagtgtgttgtgttgacaggcatgtttgtctgcctggacttcaggtgtgtgtctgtggtttctgcagtaactgcctgcggaattgtctctttcaaatgcagaggtgttgggtgtgaccataggtgaccatgggtcaaggtgtcctatggactcctgtggtgggttttacaaggtgggccttgcctctatgggcaggcctcacagtgtgcacatttatatgggcttgtgacccttcccagagctctgtgtgtgtgtgcgggtgagggctgtgtgaggtttagaccgtggccctcatccttggggattagctacccckgcagttgctggataccttttgagtctcatttactgttgttatgtgaccctgccggggcaggcagggcttgtagccatgagtggggctgcatctgggtctccctggacacacctgcccgcctctgtggctgygtgttgtcatgcctcttgttctcacacgagagtggtttgtggtgttaccatagctttgtgtgcagttactggtgtgcagacctgcacaggtgtgggtttgcatttgtgtgtgtatctctcctggtacttggacctgcatgtgtttgagtgggtgtgctcctgtgtaactcagaacgccaatgtgtatatttgtgtgttagtatatagctctaagaatcactgtgcacagtccccatcatatgtgtttgtgtgtgttgttttcttggtacacgaaacatatacgtggtgcagtgggactttaaatattggtgtgcaggcttctgtgtgtgtgagcaggaggggagggagaaagatggagagagagagagagagagtgtgcgtgcttcctggtgtacaactccatagcacatgtgtcagcaggagccgcctgagctgagccttggaggggcagggggagggtcaccatcctggaggctctgggggcttcccaggcccagccccsarccgggccagccggcagggatgccgccttccaggaaggctcgcagggagttggcgctggagaggccrgggctgccaagcgcagctggcagacaccggattaactctgcgtgtgccctggctcacccgggagagggtagctcgagtgtgcgagggttcaggtggctcatgcacaggtgctgggccgctgggcatcccagtgtcctcttccctgaagcacccccagctcactccccttggagaggggtgggctgtctgagcagtgggctgtggcctgagcctggttgactgagccttgcccccttccgggagaggtggggagaagcatagacccctcctggggatccaggatgggctcatctctgcagctgggacttggggacgatctgtccctccccaagggtagcagcccgtcagggagcaggactgagtgggtgggtggctctggccctgggccctaggctctgggttcacctcacttggcaatcggccagaccctgtggttctcccacacagaaccccctcccacgatgctcccgtcactcccgcttgctactcagacaggtgcctcggtcactgatcagagctggtgggacccggagggccggggcgggtggagactcctctggggcttggcgggatcagctgacctcsctctcccctgtctctgttgcagaacacagatctatttgagatgattgagaagatgcaggtgaggatggctctgtggcctgttctggggagccacagagctggctgggctggggctggggggcccttgctgcatctccagcccttcacctcyctgaggacaggccacgccrgtagaagatggtggctattggttgtccagggtcctctgtctggaggtcagggtagaggatgcccaaccccatctctgatgccggagtccatctaggctcccagctcccatccctgtgtggaactgcaacagggctggggtcagttcatcaacccaccccacagacatacactgcctctcacccagtgagagacaccgcaggctttgtggtggggggcccaggtggaatggaactggaggaggggacagatgctsggggcctgtcagccagagactgtgctgcaggagtgggaggtattacccctccaccctccaccccacagccccgtctgcgtttcacataggtatgcatgggaggtgggccgggggtgctgggatgggagtgccttraataccctctgatcttygatgcctcctgtttctctttctgtctctctctccaatgcctcctatttctctgtctttctgtctcgtctctgcctctccctccccctctctccctcaacacatatctgtgtagataacagyccccccacccgccagctcgcacaccggcatgtgcacctcccctgcccccactcccagcggcacgtgcgttcccgcagagtccccagccctccctgaggctgccagcctccagccccggtcactaccgggacagccagcccttcagacaggcccagggcccccagccagctagcaccctgccctgggagtacccctaccttcgcgggccgcctcctagggctttccccttgcacgccttggggaggggaggcagcrcctggcggcaggcctgggagggtgtaacagtgctgccttctcttacagggaagcaggatggatgaacaacgctgctccttcccrccgcccctcaaagtaggtgggcctggcagtctgcctccctctctagggggtggagggggtccgggaagtgctgccaccactgcccatcaagcaggaaatccatcccctttcagcaagtagtcttacagtgtgccaggtgcgggggtmgggggggaggcacagcttctagcagggtagacccagcccctgccctctaggagttctgtgatggggagaacccctctcttgctagagggctggggcctctattctagctcctcctctcggtcttcactgctgcagactccccctgcctctccaggcgtccccaccccaaactcaaagccctcctctctcaaagacagctgctgccaaatgttttccctgaaaccagtgatgaccagcagttgcaggaagactccaactcaggccctaggagacttatgagctcctgctccataagctgctgtctggatggggagggagtgatagggaggcaggcctgggtgccccccagccactggtgaggagactgaccggaggcaggggactcagcgagatgagggggaggctcttgtttttgacccacttttcttagcatatggttcttggtgagagatcccagagaccctagaagaccaggcctggtggagtgggcccagggctacagggtgagggttagaggagggtgcatgggcagtaagcctgatgctctctttggggcagaggccctcacaccagcagcgtcggtgccacctgggagcctgtgaggaatgtacattctcagacccckcccagaccgctgcatccaaagctctagggtggggtgcagcaagccctccaggcagtccagcggtttcttctggggaggcagtgagccctcctttctccaggcaaggagagccccagaagatgccagcactcagcacgctaagcctgcctcagcccctgcccatctgtaagaggtgatgaggccagggccccatccgcactctcagccctgaggctggccaagcagaggccagctctgggggcactggaggatggacagatggagagacccttgccctgtttgtgttttgcagacagaggaggactacattccatacccgagcgtgcacgaggtactcagctagamccccgcgcccaycctyactcaagcccaggaggcacttacacagggcttctggataccaggycctcctccttaggagcctgacctgcaggccttgctgcgggctggagacttaatttrcaggcccaaggcctcagagcccatttgaacccttaggccttctgagccaaatgttccagcctcctgggccaaggtcatgctccagctctacctgcccccacaccccctgttagagacttgggtctcrgcgctstctgggtctggctgagggaaagggctggagcagaaccctggggcccacacaggctctggcctgtcccctcataccccttagccacgacagaagcggctccaggtctgagttgggaggstgtyctggggcgcccagtggggtacagtgtggggtggctctcagctgagtccctcttcaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaacccyacagcccgcatctaycggaagcactttctcggcaaggtgggtggccggctggtkcagcggggctggctggggtgggtcacagttcagccccattcgaggtgggcctgggagggagcagaacccatgggccagggctgggtracagtcctagagccctgagtgaatgtgctcccaccacacacactcccagtccccagggaacatgcatggcagaatcacttgttcattcaacattgattgcaaaggcagcattatggcatggtggttcatggcagagactctaccagggcttgaatcctggctctgccacccactacacaggacatcgggyaaatcgcttaacttctctgtgcctcatttcctaatctgtgaaaatggtggttggtggtaatgatacccacctcctgaggttgctgtgaggctttagtgagctgatatctgtaaggtctttacagtggtgtctgggacaaagtaagtgctcagtcaggggtggcaaataatgagcactagctgtgtgcctggccctgttctaggcaccaggtatacagcagccaacacaatagacccaggccctccctttgggcagcttggagttaggagaacagtaatgtcatgggttgatgcagcccctgccccaccaccagcacagagcagggaccctgcccagcaacaacttgtcagagtgttgtgggagccaargggaggtcccatgccgggaatgtgtgtgtcaggttgcaggccgggtgctgtctcttcgtcagcatagagccaaaatggggaagtgtgtcgtgggctctggagcctcgtggcatgtgtgggaatcttggctcttccattaactgtttgtgtgaccttgggcaagttatttaactttcctcgtcggtgaaaacagggataataaaagtacacgcaaagcttctagaaccacacctggcacatggtaaatactcagttaatgttagctgttttcatgtcttcataattacttggtgatatcaggattattctgtttttgcagaagaggaaaccgaagctcagataggtaaatgatttagtcaaggtcacacaatgactaagcctgggaattgaaccagctttggctgaccttccattaaggtgcatgggagagatcatgctcctagtcattgtatrtgtgtgtgtgtgtgtgtgtgtgtgtgtgtgtgtgtgtgtgtgtgtgttgggaagagggggtgactccttgggggttcggaagatgtgtgacctcagtctgggcctggccattggcctaactctgggagacaccggtgctaaccaatggagttaggggaggatccactgtgactgggactaaaccagcaagcccaggttcaggagcctttgcctgggaacaaacccagaacccagcatggaattccacttcccagctgagccctagaggtggagcgagacctgcatcctaggcacctgctgtccagaggttcccagctgggtctggcaggtggtaggatctgagggtactgtatatgccaaacacatggttggtactcagaaaagtttgttgaaagagtgacaagtgacagatgaaggtaggaacagatgaaggtagtggacctcgagtgcagcaggctctgaagaagtgcagactggagggtcagaagaggcagctgggcgccstggcttatacctgtaatcccagcactttgggaggccraggtgggcagatcacttgaggtcagaagttcaagaccagcctgagcaacatggcagaaccccatctctaacaaaaatacaaaaattagccaggtgtggtgctgggcgcctgtaatcccagctactcaggaggctgaggcaggagaatcgcttgaacctgggaggtggagattgcagtgagctgagatggtgccactgtactccagcctgggcgacagagcaagactccatctcaaaaaaaaaagaagaggcttcatgtccaggatcagattagcagtaatgagggagaagccccagggctggcagaatggcagggccccttcctgactccaggtggggtaatgggggaagcagccaggtgctcakgcactgggccctatcctggcagagaggggaggttaggatgactttgggcgttgacttcctgggaccctgagcccgctctcccactgtgtcccgggggctcctctgggcttgggggtgtccaaggaamctccccactctctggacttccctgccaggggcctccttatcaagtgcctgccactccctctctgctggatgatgtcaagcatttgggggtttctgccactctgtgcccaggcagagctgggggactctgccccaggtccattgagaatgcccctgagctgcggattcgtggggcacattcactggtccctgcctctatctgctcctggcctctgagcacaggtgttcatgtttgaacaggatttacttctaggatgattcctggggcgggtgtggccgggcagccagctccactcccagaacttgggctagggctggggctgaggttggcaggrggagcccggggccaggctgggtggtgtctccctgaacttccagccctcggctttgggacttccccacccggaggtgccagccctgggctcctctctgggggtgccatccctgccgcagccacccctgatactccccagggtgtcttcccaaccctgtgccctctcctccaggtgagacaggagggtggaaacctgcctggccagccaccctgtgtgttgtgagatgtttcgcttcctgtttctcatgggccctggcttcaggggccacagagtcacaggttgggcartcagcttttgctcattgagcacctgctgggtgcccagccctgagaaggaccagggctgaagacaggcatgcaggtccgaatatggtccagactcgatgagcacccagagatccagcgttactacccaccttcactgaactgagccaagcacttcatccctttcagtcctggctgccaccaaagtacagggttccctcctatttggcagactaggaaagtgaggcacagagmggccaagtgacctcctcaggctgcccagctggtcagtggcagagtggggctttgagtgcaggtctgtctgatgtggggtctgctatcagccgtgacacctgctatcggcgaaggacctgcatctgggagtgggttggctttctggccttgtttccaaaagccccatgctcagcctcacccactcccctggcccccacctcccactgcaggagcatttcaattactactcactggacrctgcyctcggccaccttgtcttctcactcaagtacgatgtcatcggggaccaagagcacctgcggctgctgctcaggtgagggtggtgggggagtcctgagatggcaggaagggctgaggtcttacaatctcagagcccatctcatttgacccactctcttcatcaaggcccatagaggggcagggatttgcttgaggttgcacagcaagttagtacccgagtcagcctgacacccatcatcacctctggtcctcgctgtggtccacccccttctggccttactttgtggggkgtggggttcccattttcctgtcctgctgcccaggccttcatcgtgtgactttctcttctcaggaccaagtgccggacataccatgatgtcatccccatctcctgcctcaccgagttccctaatgttgtccagatggcaaaggtgaggtctccgctccgctgagcttcccgggctggctccgcagatgggcacctgtggggcttcagcttgccttggcgcgtccccttcagctgtaggccctagccctggcctgccgccctrtcctgaggctgtctctcacttgttcccatcgtgtcttgggctgccacgtgttctcctaggcccccgtcccctgcctgtgtgcttttggttttctctatagcaccttcagatctcaggggacctccgttccctgagcaacagtgaaccccgagtcctgctttagccttggccattcccagcatgkctcctccccagaccttgaccagggaggcccaggcagccccatcctctcctccctggccccacacctcacacccctsccttatctcctcctgcagttggtgtgtgaagacgtcaatgtggatcggttctatcctgtgctctaccccaaggtatggctggatctgggcacagctcactgagggtgggtgagtaactggaagactgagcatttattaagcaccttctgtgtgccagatactttcccaaggttctctcatttaatcctcacaataaccctgtgaagtccacaatttgcagaagaggagccaccgaaagggcctgtgcstwcccccagggtgcacagcagataggagggcctgcgtttaagcctcggtttgtctgccttagaggctggcctcacatctggaacctctgtgatgtttggggaccctcctgagagcaagctgtgccatagtcctcccctggaatgggtgtcttttctaccggccttgcctttttatcccagaggagacctatagagagagaatagccctggcacttcctgctcggatgctggtagctgggctctaggcactgtgacagtgtggggataggggcacgggcttctgccttggatgagccaggggcacctcctggaagaggacagacaggtaaacccttgggtccctgactgaattctggagcagtgtgaggtggtgtggtccaggaaaggtatcctgaaggggcttcagaaatcagggcccccctcctgcttatgggagaggaaactgaggcctaaggtraggaggagaacttgctcaatgcccacagcaaattggtgggacgtgtcctgttctgggaggatgatgtgggtttacagaggagccgaggagtgagttgggagttagagtggagkaggggtgggcttggcatggcaggacyggggctcacagcaaaactcaggagcgatgaacttaagctttggaatccaacagacctggggtcaaatcycaagcctgcatgtgcttgcaagccattgaccctaggtgagtcacttaaggtctctgaacctgagtttcagaggggacagctggactgtctccctcccaggcttgttctgagaatcacatgacgtgacgtgtgtagagcgcctggctcagtgcttggcacgggggaagagcacgtcgaatggcagcttgcacacgcagcctcttcacccggcgtcctctcctgcaggcttcccggctcatcgtcrcctttgacgagcatgtcatcagcaataacttcaagtttggcgtcatttatcagaagcttgggcaggtgtgctcacctcctccctgccgcccctccccacctggccccatatctggagsctcacaccttttccagggcagcacaccggccaagggactcaggagcccaggggctgccagaggtcctccctccggccctctctgggtccamgtagggacagagggcaggggcttctcaggaactccagctcaatgaccttggcccctcatccccagacctccgaggaagaactcttcagcaccaatgaggaaagtcccgctttcgtggagttccttgaatttcttggccagaaggtcaaactgcaggactttaaggggtgagtattakggtgggctgagcasagtgtaatctgacttgtgctcctgggcagggagggagcccctgtcctggccccatggaggcctggccagggctggagactgaggcgtggcctggggggccccggggcaggttccgaggaggcctggacgtgacccacgggcagacggggaccgaatctgtgtactgcaacttccgcaacaaggagatcatgtttcacgtgtccaccaagctgccatacacggaaggggacgcccagcaggtagcctgggcacccccacctgcctcctgtcttccacstgtcctccccctccacstgtstgttcagcctccatcacgccaggctcagcgctgggccctgggatggagatggaaatgatcagcgcccccacttgtgggstctcgttgggtcaggggagacagaaagccttggtttctacagtcagaatggcacccacttcctaggtgagcataaatgcgtgggtgcatagagggactagaacagtgcmtagtacattgcaagagttcagcagatctgagctggtgttttatggggagtggagagcatcatggggtcatgtggggacatgtagtcttggcagaggtgggagtcaggaaaagctttcaagagaaagtgacttttagtccgtgaaggagctgggagaagraagggaaatgttccaggtggcgagaacagcttctacaaaggcctggactcgagsacatgcaaggcatgtgccaggaactgaactcagaagcgtgtccccttgtcctgagcctcctacagggctatctgccttcccagtcaggtccccagcccagggggataaaaggaaatgtgagaaaaatggaaatagctattccttatttttagtgtcttttgactttcgtttactaagggtctgtgttcattttagcaacatgaatgtataccaagttgagcttgtttattcaattgggggccatgtttggggcattgagataggagaagggctgagaggtagggtctggggaccaagagacctgggctcgagtccccaagctcattatagctcattatagcaccttccaagtcacttctctcggccttgatatcatcatctgccacagcatcccaagaaaactaaaataatttttcttgtaatttcaatagatatccaggtacaagtgggttttggttacatggatgaattgaatagtggtgaggtctgggatattagtgtaccctcatcacctaaagagtgtacgttgttccaaacaggccatttttcaactaaaatagttttaagacaagtttytttgctacattattttggggaaagcaaatccttagatgtgccctctgactaccccaaaccctcctaaacccccgtgggcacccctctcccccatgggccccctctggccagaccacgaaggcccgtggctttgtgctcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtgggcgctcttggagcctcccaggggcatcagcaagggccctggctgcagctctgccctccctgggatgcccctctgagcctcactttttccagctataatggggggaccatggaaggcttcaatggtgcactgttcacaccacgccccctgtcgtccccaaagctcaccccctcagagaggacagtttccctcctctgcctcctggcctggtatcactgtcctccacctcccgtagcckcctctgccttcaccatcccgatgattcctaaggcccctacccatctccaccactaaaattcagggcaaaagatagagggcagaaatctctggaagaaagattcatccagcccacagtcactgggtctccccgaccaaggggcagtccagggaggcacagtaggggtttctggctgggtggggcagagcagaccccaggctccacaggaacagacagctgccctcccttccaggtctctgtcactgcaagagatgatgtgcccttctttggaccccccctcccggaccccgctgtgttcaggaaggtgaggggcacccccccagtcatgggcagagcaggasaaatgggtgggggcctggggggtgcatacacattctgccttatgaggtcccaaagtctcattgtatgccagggcagctgggctcccctaactgcaaccggggcctggcttttccattcatcttgaaaacaccttttttttttttttcacaaggtcacaggataaactacacgattgttttacactttccatagtaractggcctctcctcatttctgttctctttctgacagttccagtctctttctttcttctaaaatgtttggggaggggcacacttcaagcctgggcttcagctctgtacgtagcgtgttctgctaccctagmctgaagcagtaggttgagaccccaacccagaccctaacatctgtggagtttgctctcccgaaggcgtgggcagccatgaagggcactggggccccttgaaggtacctggggagctgagcccagggagatacccttttgggagtgaagagggtgaccccaggccccagcagagcatggttcaggagctgcagcctctgcctcgttggggttccracccttgtttatgtgtcatctcaayttcccttccttatctcctccacactgggagtttmcaggggcctgagttccaggaatttttgctgacaaagctgatcaatgctgaatatgcctgctacaaggcagagaartttgccaaactggaggtgaggatgggctgtgagggctgggtgaccctcttctcaccttccaacctataacttcagccctgtccctgggaagggaaaagccatgttcagaccttggccttagcggggacacctggggctggatggattgatggacgagtaggaggtcggggagaggaagccggagggatactgaggagttcccasgagatgctgggaggcggttaggctgacagggacaccttgggacctgtcaggtgggggggtggacctggggggtggggacatgaagccagatcttgaaggggctttgaggggcccttcatatgagggtccctgggggatgcttgagctgtggagtggcctgggggaaggcggtgcaggagccctccgccctccccactccccactcattcagagaaggtggcccgtgcctcagaaggtggccaggatttgaactgtgggccgaagggctgatccttggggtccctcctgacggcccgggcctggcccacaggagcggacgcgggccgccctcctggagacgctctatgaggaactacacatccacagccagtccatgatgggcttgggcggcgacgaggacaagatggagaatggcagtgggggcggcggcttctttgagtctttcaaggtgaagggccccrggtctaactggccgsggagcagggaygtggctagggcggaatcccgggctgaggctgatagactgatggacacggcgtgggggtggagtctggcagaaggggcgtggctgagggggtggagtcccggactgggggattgacacagcatggggagtgcagctagaggccgttcgcattggagtctgagagggggcgtggctggggcgaagtcccggactggggctgattgacatggtgtggaggtgtggctagaggccgctcgcctgcgggtagagtctgggatgggacgtggctgggggtggagtcaggggccggggctaatggacatggcgtgggggtgtggctagaggaggctctagtctgggatgagggcggggctcgaagtggacttgggctttagaatgggcttacacttggggacatagtctgccttgggtagagtttgaaggagcagcatgtaaggtggggccctggcttggggaggagtaactgttggaggtggggcmtasgtggggaattcacctgggaattctgctgaagggtggaggattctgggagacarcaagggctgctggtacaaaggctgctakgtcagcasgaagagaagagaggaagaggctctgtcttgactgagggaaagttctcagaagaggtgtgtgaaccatgatcattggagagggacttggcctgtgtgacctaccctgcctgtccctggkttagcttagcattaagagcacggacacttcaaatttcagctctgttacttaccagcttgggcattctgtgagcatcagtttctttatctgttgagtagggtaatggcaacttgcctcatacagttattgttatctgtaaaagagttaggttagtgcaatacaagtttaaaagcaaaatgcaaaaccttgcctgtctgcctcagcaaatgttgtctgaaatgagaagtgtggggagtggagtagttcctggacagggtctggactcactcaggccacagggccccaggtggtagcctttttgccaccgtctcctccacccacaggaggataactgcccatcctccagcttcccggccggctggtcacacctcaccctcaacccaggacaggtcacacagctggagctatgggttggaataagggaattagcccggctgcccaggcctgcccaggaactgaggtgaacagatcgtctttgagaaagaggcttggggactggagacaggacaggtggggtcaatatggatctggggtgtctcctttgaggagggctccgatggtcccacatctggtaggtgctggacggtggacctagattaggtcaaagaatttctcagaagcagyggagtccagagttgagggcatgggtcctggcatgccgggctcacccctgcctcagttggcatgaaatgggcatgattgctagtccccatcttgcagggggatccagtgatagagtgattgtaaagcgctggtcccatagcaagcatttggtrtagattggtctgaaaaaaacaaggaaagagggtgggagggaagaaaagaaagaaggcaggagagctctaagaggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccycgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttyacagcgggtcatccggagccgcagccagtccatggatgccatggggmtgagcaacaagaagcccaacacygtgtccaccagccacagcgggagyttcgcgcccaacaaccccgacstggccaaggcggctggaatagtgagtgccctccccctccccaggcccckgcccctccctggggggccctcagctctcctctgcctcctgaggcctgactccaactctctstgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctstgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatccacccacctacccatctacccatccacccacccacccactcatccatccacccacccatccacccacccatccacccatcaatccatccatccacccacccatccacccatccatccatccatccatccatccatccatccatccatccatctctatccatccctctatctccatccatccatccacccacccaccgatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtcttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccrttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagaraagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcstgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcasgagaagaggtgggtgagtgggggacagtgccccattcccctgcayccccatccctgagccccattcggtggcaaagcaaggcaggcagaagggagtgcccgcccctctgcctctccatccccactagtgacagctgtgtggtcaagtccctgctgcgtgtcgggcaccagggccagcacgtcacctaacgtgccacatgcagatcaagaagcggtaggtcagaggagtcaaggggcttgcccagatcacacagccagtgatgggcagagctaggatctgagccctgatctgtctagggccagcatccgtgctcttcccacggccccagcgcatgtgggagggcmtagtgctggttttcagggtggccacagatgggcctggggggtccatgagtgtgggcagcatgagggcagtgagcccaggccagcagcagggctgcccccggacatcagaggctagctcccggctgcctccccgatattaaccatgtgtgaccttgggcgagtcactgacctcctctgagccttactgtcccaacctggaaaagggacaagaacacaacccatggcatggggctgctgtggggactcagggcactgcgtgtgaggccagggccaggtcccctgagagggctccaggacgggagtgggcattgtccttgctgctgccagagctccgcatgctgtgagtcctgggttcaggtcttggcactgccacgtcctagctgtgcgtccctgggcaggttccttatccataatgggacagctatacctgctcctgtggagaggacctgggaggagtcccatcctgtcccatatagccccatcagtgccaaccccatcactggccaggctagccagggagcccacaagactgctccagggctggccctgagtataggggcgtgggtatgaggcaggaggcaccgtgactcccctcaccgcctgggcctcacgctacscctgatgccaggcctggtgctgaatccccccgctgcccccgtgtgccccgcagggagagccctccggctggtcagaagaccccagacagcgggcacgtctcacaggagcccaagtcggagaactcatccactcagagctccccagagatgcccacgaccaagaacaggttggggctcagggcacgtggggcttgggggcttgggagtggtgaaccgtccttcccctcccctgcctgggcccgggacagcacaggagccttgactgtgccacagcagggtgtcagggggacctgggcattctctggggccctcctttgacatatacccagcgagcactttgtgcacgcccagccccgcgcccggctctggagcacagaggtgccctgcgcataggtccccgcctcacggccgcaggtccatcagaacgcggcctcataggctgttgccggatcatggtgataggaggaacccgaagcagggttggggggatgaagagggactgggggcagaggtgttttagatgsgtcctcggggagrcacctccatggggtgacatttgaattgggaactgaaccagccctgctaggactggcatggcagaggagctcggccagtgcagaggcctggggcacactccagggacagaaagaagggtggctgggagtggtgacgtatgcctggagtccacctacctgggaggctgaagcaggaggatgattttagcccakgagttggaggctgcagtgagctatgatcatgcctgtgaatagccactgcactctagcctggacatcatagcaagactccattgcttaaaaaaaaaaaaaaagagtatctgaggggctgggcctggacagacattgtgacattgtgctgggtggtggcgggaaggaggttggagaggtgggcagacactggcttatagcttagcaggctgtacaagagctttgacttttttttttttttttttttttttttttgagacagagtcttgctctgtctcccaggctggagtgcagtggcacaatctcggctcactgcaagctccacctcccgggttcacgccattctcctgcctcagccccccaagtagctgggactacaggkgcccgccaccatgcccatctaatttttgtatttttagtagatacggggtttcaccgtgttagccaggatggtcttgatctcccgatctcgtgatccgcccgcctcagcctcccaaagtgctgggattacaggcgtgagccactgcgcccagcctaagagctttgacttttatcctaagtgtgacagggaaccttgggaggattttaattacgagggcgatgctttaagaagctgacttcggttgctgtacaaagaggctggagtggggtgggatggaagcagagaggccagtgaggaaactgtccctgcatttggtgtccgttggctgagctgcctctgtgttgggctctgtgggaatcaagaggactcagcccaggctaaagagccgggtaggtgaacagagaggcaggaaagggtggcagggaccagggagacgcagtatgcaggagccagagtggggagggtcattctcaccttgggaggaggaatcagggaaggactcctggagcgagagccctaggctgattttttaaaggcacatttgcttttcgggatttgagaggactgagactccaggcaggaggcatagaggccctgagcatgaaaaccttgtgggattaagagagtagactgtggagttgcctggacctcaacccctgccctcccacctgtgctgagtgaccctgggctgtgtgcctgtcccctctgtgcctggtgtcatctcatctggaagatgggtataataatcatagygataagataattcaggtaaaggcacgtagagcagtgcccggtgcagagtgaacgtgcacccgatgatgttagtgtcgctaaccgctgctgtttttgaacaccacgccaaggatattgtgctttacctggggaaatgggaggccaggagagggttttgagcaggggagggacgtggtcagatttatggattaggaaggacaatgcgggtaggaggaggctgcagggggagtctggggggctcagaggcccaaggatctgtaaggggtcctcaaaggtgcttggctgctaccagctgggcctcccgggttggrgagggcaagggagtgagggcctggcccaggaggggctcggggtggacaccggctaatggggcactgtctgtggcagagcggagaccgcagcgcagagagcagaggcgctcaaggacttctcccgctcctcgtccagtgccagcagcttcgccagcgtggtggaggagacggagggtgtggacggagaggacacaggcctggtgagaggctcaggggggtcaggggccccacaggagcttggaagggggctctttggtccctggagatgccctgagtagaaccacgagcctgggcgtggctgagatgtgatcaggggacccggcccaaaggagcagtgcagacgaaccctcccctgctcagaagccttccacggctccccagcactgtccacaggaagctcagtctctggagctcttggagatctggtcactcccttcctctctagtctcctctcttaccacttcagacattctgtactccgttgcagtcccccaagcctcccaggctcactgcacccctggccctttgcrcatgtgccatctcttctgtctggaacactcttcctgccgcctcctcctttctttgccaggctggctctgactcatcctttttgactgagtctcacacacctcctcctgaaagccttccctgatttcctaatctcggggtaggttaggaagcccctttacgttctcacagtcctcgggctttgcccggaacaccctttatcattcttcattctgcaaaccatcagtgggcccctgttccttgccaagcgctgccccagatacaacagatrcagctgggaacagtgcagacccaggccctgcctgctggggcacagagtctagaattgcaatggtctcttcacagcctgccttgcctcccagatatcaggctcctgagggcagggcccatgcctgatttatgtcagtggcaagccctggagaacatcagtgaatgtttgttgagtgagtgagtggcagtgggtggcgtgtgcctgggtctgtgcctgccctgactctgccctcctgtggtctccctggggcagacatggctaggcccgtcctcctcgcagrgggtacgggtggggggttgtggaatgcagtgagggagaggggctgggagggagccctagccagtgccaagggcataggctaacctccctccctctttccaccccctccccaggagagcgtgtcatcctcaggaacaccccacaagcgggactccttcatctatagcacgtggctggaggacagtgtcagcaccactagtgggggcagctccccaggtaccaggacaaggcagcttccccacaaagcagggctaccttggggtaggagggggacagggctgggcaccagttcccatgccccatgcagtggatgtgatgtgactgcccctgacttggaggacagcgggcaggtcattgtccagcctagggtggctgggtggattggagggctggtttcttccggaagggtctcggaggataatgggggatggcaaggaagaaagttaagggtggggttggagcgcactggtgccgaccgcccacctatgcccccgtctccctggtgcctccccgcggccagtgaggtggctccctcctgcccccctccccaggcccctctcgatcaccccacccagacgccggcaagttgggggaccctgcgtgtcccgagatcaagatccagctggaagcatctgagcagcacatgccccagctggtacgtgcagcctcctggggctggtgctgagggagccccacccgggaggggatgagctggcggggaggctgggagctgaggctcgaccaagaggtccccctaggccccgctaggccaggaggggtggggcttgcccggcctggacacagccagtgactttgtgcacctgtgtctcccgccccgttgcttctcccgtcttgccacctgcctcaccaccactgtctgtctgcagggctgttagccgggccaccccctctgaaggtgaaactgagcaggttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggtgggcccctcccagggtggggttctctgaggcagggacttggcagagttggggcacactggtgccagccacccaccatgccatgtttcatggtgtctccatccccctttgccctgcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgsgctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaargccagcctcctggccccaatacccattttggaagcccctgtggccgtgtggatgtcggtaacagttgtataaaataaattctatttatcgctattgtacccagagttgggcctggctttgtgtgaaccgtggccagattgaccccagacagatgtccagggatgtcaaggtggcagggagcaagcctgtccccatcagagctgctgggcctggggacacctccaaagccaagccaccagctctgtgagcaccgcccgtggtttcctccccggggtgctgtccttccctgcatcctgggccccttccccactgcaggaagaacatggctgtgctgtcaggcagacctaggtttgagtcctgggaccgtctcttgttagctgggtgggtggcgttgagaaacttactagcttccgtgagcctcagtgtttccttttgtaaaataggagtggtagtgtttctcccaagggtttgttgtgaggattcaatgagctggtgcgtatcaaacatacagcacagtgtctggcacacattaggtgctcaattaattacttccttctccctgttctcatattcagtgaatcccctgatatggccacaaggcggcgccaagggaccacttacgggacccgatggggacccaggagacggggatgagtccaagtccctctaccaggatctcacagctgggacagtaggacgaagggtgatgaggggcagccggggacaggagaggtgtgcacaagcagggcctggggagagaggcgtcagggaaagttcctggagttgctccccgttcctgagaaggcctagggaggagggaccctgcaggagggggcctcgagtaaagggcggggaggcagagcacccctggaaccaggaaggtggcagccagctctgaatggtgggaaggtgacaatggaggggacagggagatgggcagggatgaggccagaggcaatgtggccttgaactcccgacggagaggccagggctctgcgccaagggcagggggagccccaggcaggagcggtagttgctggtggaggctgcaccagtggagggaggaggggaccaacgaggttgttgctggggtaagagggtggccaggaggacgctgagaaggacaccaggtgggcctgagcagggggaccaagcgcctgatgggctgtggggctaaggggggaatcgggtggctcccgggggtacaggctgggtgttgggtgaatgaggggactctccctctggggcaggaccacggaggagagcaggtctgcggggtggctttggggacatttgggagtaggcaccaaattgggccccgaagggatgagccgtgccttggcctccctgacagcttggcagtgccccctatcccctgctggccctgcccccttcccaggatgatgctgaaggaaccccaggggtttgtccagggagtgccacacttttcccgacagggcccttctgtgaccctctgatgcctcaggccacccatgggtggtgactcacacccaaaccccagccccacccaactcggtttggctctaggctgctctgggcccagtgagtcccctgtgaactgcccacccatcagccgcacccctgctccctatccctccgccgcagtcctctgccctctctcctcctgccccacctccacagggccggcatcacagttcagcaccacggttaagagcttcttcagaatcagctctgagctgcttcgcctcctcgcgctatgaccatgcagacatgattttggctccctgggcctcagtttcctcatctgtgcagtgggggtgctaacagccctgccctcgctggcaccctggcatgaggattaaatgaggtgacacctcataaagttctgggtgcagccccagcacgtggtgggctcaaagaagagagtgtgcataccgcaggaagggatcaatgacgtccgtaattcagaacacgtggggtccgctcagtgcgtggaggacgcccacctgccactgggcccagcacaggtgcctagatgtgaggctttgggaatggacggcgtcaggtgcttccctgggcctcagcttgccaggtttacctggggtgacgatgctcccataacagagctgggggaggtctccggcttgtctccctgtacttagcaatgcacccccactccactctatcccacagctgagacagagcagcaggggctgctgtggcagagcaggtgggcagcttggtgggcagaacctgcctttgccccatccctgtccagctggtgccaggccgtctgcgggaaggaaggccttggggctgggtttcaccctaccgcatccctccaagctccgaggtggggtcaggggaggctggcaacggatcgggcctctgggatcaaagtgtccggtgctatttctcttgtgcccgcgccagctctgtgctcaccctgggctgtgaggtgggagggcgagccgggacactctgactcgaggctggaattagaacttgggcggggggtaccaggctccgggaagcgctggactctgcttagaaattactctggtagtggaaacagcagccggggggttcctccagacacaggagggaagaggcctcccgtggagggacctgggtgcctggaagacgtgccctcccccatctcccctacctcacagcaggggcctcctgtctccaggagtctgtttccttacctggagaatgaggacaaggcccctacctattgctctgaagaggctgtcttggcctctaaggtacctgggatggctgctggcacagaacccgtgcccaatacaagggggtcctcccctacccacccccagctggggtgttcttggacctccatggccaaccctggggcaactttgccaaggagatgaccgcaggcccgggccggcygtgccaggggactgggagctggacgttctctgctgctcaggccacagggggtgctcagccagggaccctggaatgtggaggtccctcccttcttccctgctcccgccttgccaaggggatggagcctcctgaaataaccagatctggttagcgaggctaattttaaaagccactctggctgccccataggccgttctgggaagccatgaatgtccctgtgtttgcccctgggaggcagggcgaggggagagccctggggctgaggccggcctctgaatggactcccacccctgcctcccagggccggccagtctggggcccaacgttggggctcagggaccccacctctcctccaccccaatccactcaggcaaatcctagtgggctttcaggaccctccacccgcttcactggtctcctgaagcagctctgggcagggatccggaagctctctgtctccctctcagctgtctccccctctgtctccagtgctcagtctctgtggtgtccctttatctctgtgtctctgcctctctctgtctctgagtctcgtggtccctctctgcagctgtggctctctccccctctctccctggacccatcacacaggaggcgggatgcagtgttcctaagggtccatacgctgggctctgtgcactgggtggtgggcggctgtgcccacctaggagctggggtttcaggtgcggcccagcgagggagggaactagtcctggggaccaacaggagctataactgggcaggcaggagccaagtccagacacgacctgggccatctggccaggcccacttccagcaggaggaaagagctccaggtctagggttgccagatttagcaaatagaaacccacggtgcccagttaaatttgaatttcagataaacaaggaagaatttttagtttaagtataccttgtgcgatatttgggacatacttatactaaaaaattattctttgtttgtctgagattcaaatttaactgagcgtcctgtattttatctggcaaccgtctccagggaggctcttggagtgaagggagaggtttctcaggaaaggcaggttgcacaggccagtctgatggcagtgtcacaaccatgccctggagaaatcccagtctgatgagggaggcacagctacagaccaccaggagttggtgtggggacagtccttgggaacgtggtggggaggcacgtgacacacagtcttcttaatggaaccagagacatcagaaggaagggtctgtgtgtgcatgaatggctgagcccagcaccttgcacacagtaggggctccataaatatttgctgaatgaatgaagaatccggggaatggagggggatgcgcatccggggaatggaggggcagtagtaccctactgcccaagctcctaggaaccaagtgtgtgccacccccaacccagggactccccaatatgagctgcaaaggggacgggagggggcagagtgggtaaagagagatcagcttttcccttattttggcccctccccagaccccaatcctatgtgggaattcagccctgggcaagggtgcaggtggtggtggggactagggcaggtgatctacccttgtggcatttggggatggctgggatgaaggtgggggggcgcaggccagagggcactgctcagtgacgctgctgtttctcaggggcctcccgtgtgcagtgccctgtgccctagcggggtgttggacgagacaggggacccctggaacccgggaagtgaggggtccttgtttctgggcaggtgagacttgggcctttgtctgtggcccattaatctcaggggtctccctggaggtggcggggggaggcaactagggagagacctgtggccctttcatgcctccccaggggcagaattccttaaacagcctttttattcgttcactcattcattcacttgctaacaggctcgcttactcactcattgttgccattcactgagatgaccccccgaccgccccctgaactctgccccctgctcaggatctcaggcgcttgtccaatcccagcaggaacataccactggctcctggcatgacactgggcaagtcattgacccttcggagccttggtttccccagccctgcaatggggctacactagcagctccctggcaggattattgcgagaatgcgtgagatgttgcctgccccccgggagcacttccaaagggagccacggctgctgctggcaccattatcatcatcattattattattaatcattgcaaggcccccatgggttgggcaaggagcagccgcctggctccatgtccaggtcatgccgaggctgttctgggaagcgcccgcttccccttggggcgtcaatcatctcagttcccagccctccttttcaaggggtgtcagcgttttggcttctagatgcagcatgaaatcctgtagagaaaagtgagaggtggggatggagccgaagcctcgccccctcttcacctgcagtgtgaattccgggccttggtttccccagtcgtgcagccgggggctgggctgggcatcctgccagagcccagaaggggcctctccatgtgtcatcctgttagaaacggtttagctccgagcctataatcacatctacccggggaggaactaacacagcgtttctttaaattgggctctaattgcrgcttttagtggagtcacatgcaccccatcccccagccggtctgaattagggcggctgtcccagcctgccctgccaagtacaggaatcccccaggattgctgtggctcccactgagccagcggtggatgagtccagggctgctgtttctcaggggcctcccgtgtgcagtgccctgtgctgggcgcttccgtctggggaactccttgtcatttcaccacctgaggatcaggcacttctgggacctgcttgccaccaggcctcctttctattcacccagaagtggggagccaggcctggagagtggggtgttggcgggcaaggccagaggccgtgcccctccttgggggcgtggtgggggagcctgtggtttccctgtttgttctggagatcccagccgcttccccraggagacagctgacggttcccaggccacagcccctcaggcggggccagaccacggctggccagcctgggagcactgcccgccagccacccgggctccgccaggccctggcgct

SEQ ID NO: 12383 - DNA, 138434 bp, Homo sapiens
tcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgaggggraagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccrccgcgggagcctacaaacttttattagcctcggggagtgggggtggggggctggcaagggccgggcgacggtgacgaaagggcagcgcgcgggtgacagcgctggcctcttcctctccctccgcmggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtaatcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattyggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggarargggagatgtgatggacttctataaaaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaarttggartaggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaacaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacracattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatrttgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgytcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgargtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttragactgacaggtgtatatgaatacagagagtatacataaagaagatgtattttcaattgwcagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattrtaatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacrtggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcratgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggyagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagwaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttcctttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagycaaataattaaggatttgttaaatatttgtcttaatatcaagcttttgcatatcggggccctcttttataagctttataagcaatcttttgttttctctgcttgctcaaagtagctrtgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtrgtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctrtttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtstgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatayagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatyatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaargatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttctkcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtktgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccayttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctattkgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtcttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaataycttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcrtatacacagccctactcatgcatgtggccctctagatttccaggartatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaargagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccaragcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcmattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgttttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatatargcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgrtaaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagartattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacamcaggatcctgtttgtaaaggcatctgccagtggtttctgtgacacaattctgtttstagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatayttatgggaaaattttaagttgtgcccttgtttcatgtgtgtttctatttaaagataccatacttaatatataytgttgattcattaacaytgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacragctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggcygaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacrtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatawtaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctyactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactmattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaastaaatccctgtaggaactctcaaggttttgatttcwtctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattargatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtrtgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatmctgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtmcaataaaaatmcaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcstactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcwkkgtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacargctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagrtatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttataytgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatktgcaggttacataggtaaacatgtggycatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacrattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctygtgatagtgtgggagatcgcaaaacatctgatggtttaaatatggcagtttcccctgtgctttctctctctcctgccaccatgtaagactttccttgcttcctctttgccttctgccrtgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaargtttggaacgtcstagagacttgttttgaatacttttgaccaaaatgctgatagtgacgtggacaatgaagtccaggctgaaatggtcccagagatgaggarcttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttyctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagatamagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctstctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcrcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaatyctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgawtaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactayaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacytgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacracaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctrttctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccktataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcrtggcacaccatagagggcatagggccacaggaacaagaggaaggtcacctaattctgtcttggaagtcaaggaagaagtaacattgaattttamatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatmtacgtttgaccaggctatttaaacttaactgcagagtgtcagcatgttaaacattgatttacataaaatgatagctgcccactttcttgtaaatgttataaaaactgyagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctrggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgrcagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtayatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagwtaatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttktttaaatacccacagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagctctgttccagactcaacttggaggawcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggaytatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccrccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtmttcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaamcacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacayctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacrgggttttgccatattggccaggctggtcttgaactcctgacctcaagtgatccacccactttggcmtcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatggraagacatggaaaaagaaagctaactacagtgattttgtcyactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttgstattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagycaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaayaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactamaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgyccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcytttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttmtggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggayggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaayactgtttttaaaaagtatgattaatccattaaattagaataatgcacccttcatatattatggtactacagtgattcatgaaataattctatataattctacatacaatcaaagaaatataaaatgtgttttgtacrgaagtgcttatttttcatctggggaattccagtgagattggtatattctaggccagataattttttcaaaatagaggacaacaaacatgagatgttcccactgaccaatttggaagcctgatcattaccatatcttctcttgcaggtgrttgaaaatctccttaactattgcttccaaacatttttggataagaccatgagtatkgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaycctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcataatwaaaaaatctgctttttcattatgtgactccaacatgcttttgtagaacttgtacagttccgattgtccaatctgatttttgtttactgaaagtagagttacccctgcttcaggaaccttaagataatatggtgggcatttaaatgtcagtgtggcaatgttcgcctgctaatatggcatagattcaaaataagcttaaccctggtgccaaagacctgaagattatcccatccatgcctcaaatggttgtgtgccaattactgcaaagggtactaagggaaggagaaattcactcctgaggctgcttcaaatgtatgtctttatcacaaaagatgacattttatgtaagctaatgttatctagtcaaaattcttagcttattttaaaatcaactcttcaagaaaaggaataaacatttaatataaatatcatagcagtattgcacatagaatagaaaggtcgggcagggtagtggaagtcagctattctatacaatccattcggtattttccaaaacatttgatgttcaggccatatccaggaactggatgacctaacaaacttctctgagtacctttttttccacaagagatctccatcactaagaaaaaaagcattgtgatttaaaagccaaatttgccttatccatcatcatgtgcaccaagtatttgctacctgcctactatataatattgaagatacaatgtgaataagaaaaatactattgctaccctcaatcagagtatgtgattggaaaagtgtataacaaacctttcccagtgtcttcaggtataatgcagagataccagatacggcatcaatgtgtatacacattatggctgtaccattcactttaagtagtaaccttacatttctgtagaacaccttcacatacatttttaacaagcctcactgaatgaattaatgacatgaaaataatgaggcagattattctcgtttccattttataaggaagtaaactctgtaagaaagtaaacaggctcagaatttaagcactgattcatagcccctagctcccatgttattgaaatttgaatggaaagcctctaatgaggccattcatctatcagatgtcaaagagcatgtctctggcctatgagcctctcagggaactggttatgtttttctgttttaaattaaactaatgctttactgagcacttactatgtgccacgcacaatgataattcaatatattatttcatttaatcatagtacccctctaaagtactactgtaaagcagtgctattatcctcattgcatttatatcaggaaactgtggcttaaagaattgagtaacttgcctacagtcacaaagctagctccagaatccatagttttaaaaaccactattgagaaattactaatatgagctaactagggcgaatgaacccatattgatcattatgtgtctggccttttgacatgtcctcatttaatctaatcccttttgctaccgtatcaattttgacttagaaatttaacaatgatacattagtccccgcttatctacggaggatatgttccaagactcccaatggatgcctgaaacatagatagtactgaactgcatgttttttcctatattacatacctatgataaagttaatttacaaattagatgcagcaagagattaacaataactcaattacaacaatatactgtaataaaagttatgtgaatgtgagctctcaaaaaatcgtactatactgagggtaactgagaccacggaaagtgaaaccgcagataaggcgggcactattgtatttccttctcttaaaaacgtgtcctgtaccctggggtggttgatggtggaaaatactagttgcccacagattacagaatgccctttggtttgtctaatatacaacagggagcctgtctcactaatgcccacagaaaaatcaaacatttcttcaagtgatatggagcatatagggtacagtcaaaccaaggaagaaagttgtttataaatgagaactatagtgcaagttaaaatttgctcctagttttgcaggtaaagagccagactttgggtgtagaaaaaaagttgaaaatactgaggcttttacataaggtgattttttttttttttttttttttttagaatttcaactaatctcttttaacttaagtcgttcttaacagtattggtaacttcatagcactttctttctggtgaaataaccccatcctccctcttatttaggcttcctgtttcctagttaaaatggggcagtactttgttagggaagtatttttacttcacttggttacaaacatgtaagtctcagaacaaaagagtttgtgcagaccatatcagacactcaaaagactttcttcactctacccacttgagtaagagacaatttatattctgttcaccttatgtaccctcaccaaaaatattcaatagggtaataatgtgtatataatgtaaataaggcacacgtttttctatttttgttaaagttgcattgtcttaaaagtactgagtatatacatggggttttgctagaaataaaaatctaggtcatccaaaacctctacagttgttcactaggattgcaaagaatcaagataaaaatgaaactctttcaatatggcaagaaagggggacagtgtgcataaaagcaagcaaaggctcacaaaacaggagaatatgtcacaaacaccacctgatcaatttcaagacctactatgtggcaagcatgctagatgaagcaattcaaagaccactaaggcaatactaagactccaaggagaggttcctgccctcaaggaattaaagatgaaaggcaaatgactaagcaattctactcctatgtatctactcagaagagatgaaaacgtgtccacacaaatgacttgcatgcaaatattcttagcagcattattcttaatagtcaaaaagtggaaacaattcaaatatccatcaaccaatgtacagataaacaaaatgtggcacacaaaatgtggctgggcacggtggttcatatctgtaattccagcactttggaaggccaaggcaggtggatcacttgaggtcaggagttcgataccagtctggccaacatggtgaaaccctgtctctatgaaaaatacaaaaaaattggccgggcacggtggctcacgcctgtaatcccagcactttgggaggacaaggcgggtggatcacctgaggtcgggagtttgagaccagcctgaacaacatggagaaaccctgtctctactaaaaatacaaaattagccgggtggcgcatgcctgtaatcccagctacttgggaggctgaagcaggagaattgcttgaacccgggaggcagaggttgtggtgagccgagatagcgtcattgcacaccagcctggacaaaaagagcgaaacttcatctcaaaaatatatatatatattagctgagtgtggtagcgctcgcctgtagtcccagctactcgggaggctgaggtggaagaattgcttgaaccagggaggtggcagttgcagtgagccaagatcgtgtcatagcactccagcctgtggcagcagagtgagacttcgtctcaaaaaaaaaaaaaaaaagtgacgaacctcaaaatcatgctaagtaaaagaatccagacacaaaaggaccatatattatttcacttacatgaaacgttcaaaaaaggcaaatctatatagagaaagaaagcacatcagtggtttcctatggctagggataatattagggtttaagtgcaaatgggcacatgagggtacttttgggggtgatggaaatgttctaaaactagactgtagtaatggttgtgcaattctgtacatttaataaatgctacacttaaaatgggtggattttatatggtatataaattaaatctcaataaatacgtattaaaaatagaggcagccaagcaaatgtgtaattgccattcagttgtatcaaaagcaggtacaaatgcactaaatgcactttgaatgcactaaaacaagtgcagctattttttttggaaagcctgtcagaagatgtcttcattgtgctacatgttaaaggatgagctggagttcagcagcacaaagccttactcgtttaatattaatggatgcccctgtaatgtttaattagtcatatgttctacccatccccagagagggcaaccatgtacaaagagatcaccaacatgacaagtaaaaaaactcacagcatatacatgactactcatgtcttgtatgaattctaagtgttaataactgttaagaccttagtggtcttacaacttcggaataaacaaatctgggttcaagccttgcttctttatttactaagtctgtgattttgagaaaattccataatcactttatatctgtttctacatctgaaaaatatatgtagctgcttagctcaactcctaccatatagcaagcattcaatacacgttagctgttttttaagtcctcatgaaaatctaagagaaggggaattttttaatgctgtccccaaaaatgtatagaagtgaggcaaatgatgaagagcagtatgaacacagtaactgcacacaaatttccaaccctgcatttcttaattaatcaaagctatgcataaggctgagggaggctgttctgttatttgccaattctacagaaacttccaaaaaagctgaagcggggggaatacttctcaactaattccatgaggtcttcattattctgataacaaaattagacaaaatataagaaaactgcacactaatatccctcatgaacataaatgtaaaagttctaaccaaaatcttagcaaatagaatataataatatattaaaggaagatacatcatgaccaaaggattatctcaggaatataggtttgacttagcatttacaaatcaaccaatgcaattcacaatagtggaaaagaaaaaatccatgtgattaagatgccagacaaaccatttgacaaaatctaacatacactctgaattaaaaaaaaaaaaaagatcagcaaactagaaatagaaggaacctcctcaacctaataaagggcatcacacacaaaaaaattatcttccagcattatacatacttcatggatactttcctcttaagaacagtagcaaaacatggtctgctctcaccactttcatacactattttactggtgtctccagccaatgccatcaggcaagaaagagagataaaaggcatccagatcaccaaagaagtaaaactctttactaacagatgacgtgatcatctgtttagaaattctgatgtgatctttaaaaattaaaaaacactactagacttcaaaaaggctgggcgtggtagctcatgcctgtaatctctgcattttgggaggccaaggcaggaggactgcttgaggccagaagttcacgaccagcctgggcaacacagtgggaccccatctccacaacaattttttttttttaaaaataactgggtataatggcacatgcctgttttcctagctacttgggaggctgaggtggaaacatcacttgagcctaggaggctgaggctgcagttagccatagtcacaccatcacactccagcctgggtgacggtgagaccctgtctcgagaaagaaaaaagaaagttaaatgcagaattaccatatgatcccacaattccacccctaggtatatacccacaagaatgaaaacaggtactcaagcaaacacatgtagacacgttcatagcagcattattcacaacaaccaaaaggtgaaaacagtccaaatgtctccatcaaggaatggcagataaacaaatcatagtatatataaaaatgaaatattcagccataaaaaggaatgaagtactgatttatgctacaacacgagtgaagctccaaagtattaagcgtagtaaaagcagccagatgcaaaaagtcacatatagtgtgattccatttatatgacatatatagaatatataagcctatagatacagaatgtagattgctggttgtcaggggctgggggaa

SEQ ID NO: 12384 - DNA, 145691 bp, Homo sapiens
ttttctgcattcatacccaatgtttcttgcagacaaaaatcttacataagtgaacacaatatttgattttatgctcaaatcattcctaatgcatccatcatgtcggaacacatttgtgctttcaaaacaagtgataaagtggaagtgactgtactccgcccatgggtaatttcaacctactggcgtgaagtgactaaacatagagttaggaagagatctgtgttattatggagtattttcaccatgcataacctcaagagtacagagaattgtaaaatgtagtaaaatgaagacgaagtgatgagttttgagtactttcagcgcctttgctatttatttatttatttattttatttgagacagtctcactctgtcgttcggactggagtgcagtggcatgatctcagttcactgcaacttctgcctcctgggttcaagtgattcccttgcctcaacttcccaagtagttgagattacaggcatgcaccaccacccctggctaatttcttgtatttttaggagagatggggtttcactatcttggtcagactggtctcgaactcctggtctcaagtgatctgccctctttggcctccccaagtgctgggattacaggcttgagccacctcgcccagccatatttttaatacacgttgagcatctctaatctgaaaatccaaattccacaaatgctccaaaatttaaaaattttcagcgccaacatgacgctcaaaggaaacactcaccaaaacatttcagatttcagattttcagattaaagatactctgggcatgatggctcatgcctgtaatcccagcactttgagaggctgaggcaggtggatcacttcagctcagaagtttgacaccagctgggcaacacggtgaaaccctgtctctataaaaatacaaaaattagcttgatgtggtggcatgtgcctgtagtcccagctacttgggaggctgaggtgggaggattgcttgaacccaggaggtgaaggttgcagtgagtcaagatcgcaccattgcactccagcccaggcaacagagccagactacacacacacacacacacacacacacacacacacacacacacacacacacgatactctaccagtaagtataatgcaaatatccccaaatctgaaaaattaaaaatctggaacatttcttgcactgaccgttttggaaagtgcattttagattaggcatttttttctttttgagacagggtctggctctgttgcccaagctggagtgcagtggcccattcttggctcactgcaaccttcaccttccgggttcaagtgattctcatgcctcagcctcccaagcagctgggattacaggtgcctgccatgacacccagctaatttttgtattttgtagagatggggtttcaccatgttagtcaggctggtcttgaactcctgacctcaagtgattcacccaccttggccttccaaagtgctgggattacaggcgtgagccactgcacccggccgataatgcattttggctactcaacctgtataatgtgtttcattgcaaatcggtataatttagtttttagtcatggctttgttaactcaggcttgtataattcatggaatagtatcaactgactcttctaagcagcgagccttctcccgtgtgctgatgaggcagtaatctgtgtgaggtgtgcccactttgagccaggggctgcggccagcagcaaacggggggctcacatcccaaagaagacagacaggaagcagatgtgtatggaataataagaccatgctctgtgttttgtgtaccatgcagtcaaactggatgaccgggccatgctagtgtcctcattggctcctattcacccatgatctaaatcaagggtccccaacccctgggccacagactgacactggtctgatattggatgagtaagcaaagcttcatctgtatttacagcctctccccatcgctcacattatcgcccgagctccacctcctgtcagatcagcggcagcattagattctcagagaagcccaaaccctattacaaactgtgcatgcgagggatctatgttgcatgctccttatgagaatctaatgcctgataatctgccactgtctcccatcacccccaggtaggatctctggctgcaggaaaacaacagctcagggcttccactgattctacgcgatggtgagttgtatcattatttcattatattacaatgtaacaataatagaaataaagtgcacaataaatgtcacgcacttgatcatcccaaaaccatcactgtccctcccatcaccttgccccttgtccatggaaaaaatgtcttccatgaaacctgtcccttgtgccaaaaaggttggggactgctgctctaaatagtatgagatgggcccggcacagtggctcatgcctgtaatcccaggactttgggaggctaaggcaggtggatcacatgaggtcaggagttcgagaacagcctgggcaacatggtgaaaccctgtctctactaaaaatacaaaaattagccaggcatggtggcaggcgcctatagtcccagctacttgggaggctgaggcaggagaatcgcttgaacccgggaggcataggttgcagtgagctgagatcacgccattgcactccagcctgtgtgacagagtgagactccgttaaaaaaaaaaaaaataggccgggcgcggtggctcactcctgtaatcccagcactttgggaggcccaggagggcggatcacgaggtcaggagatcaagactatcctggctaacatggtgaagccccgtctctactaaaaatacaaaaaattatccgggcgtggtggcgggtgcctgtagtcccagctacttgggaggctgaggcaggagaaaagtgttaactcgggatgcggagcttgcagcgagccaagattgcaccactgcactccagcctgggcgacagagcaagactccgtctcaaaaaaaaaaaaaaaagagtatgagatggccaaacatacaacatgtgacattgggtgggtgagatctacagtttagtgctcacctattctcacacaatgacgggaggaggaccctgtacactgtgtgaggccacacaggggttgcactcgggagcacaatgaacaagcaggggctgtgggaagcaggctttgtagtaataagagggtgaggcagcccctggttctcctgggaggatgtgattggtttctttctttctttttttttttttttttttttgagacggagtctcactctgtcacccaggctggagtgcagtggcgcaatctcggctcactgcaaactccacctcctgggttcaagtgattcacctgcctcagcctcccgagtagctgggattacaggtgtgcaccaccacacctggctaatttttgtatttttagtagagatgaggtttcaccatgttggccaggctggtcttgaactcctggcctcaggtgatccacctgcctcggcctcccaaagtactgggattacaggcatgagccaccacgactgggcatggcttgtttcaataacttctcagcagctagggaagtgaagtctgtggctgatgggtggggtgcagctggtctggttgcttggtgagacagccaggtggagagcagcttctcttgccaggcagggggcatatttggcaagagtagctgaacggtcggtcaggacatcgtggtcctgtgtggctcaaccatgccaaggcagcactgacattttagaccttacaaaccaggcaggcacggaaggcacctccgggctaaccctgaaggtggaggagagcagccggtcttgtgatgccacggggaagtgcatcccaggcagaggggacagctggcaccttggcccaagatggtggtggtgggtgggggtctgatgtatctcaggagcaaatgtggccagagcccaatggtcaagggggaggcggagggctcaaaggctggcctggaggctgaggagtggaggttggcttaggtaggagtcagagttggcctggaggggcccggaggggtggcatggggcaaacttcgatgatgagggtgagatcagatgctgcttcttggtgctagatttttgcacctccatgtgagtttagcagcctgtttggggttggcctggtctgagcttggaggcaggcagctcctcctcttctccaggcaggagagacggctactcaatctactccggcccctgcgcgcgtgcacgcacacacacacaccaacacaccatcatcagttacgtcccctctgggttgtgtgctcagtggcagcaggtcctgtatgtcccagggtcctcattgcccagcccagggcttggtgctgcctgggtgatcagtgttgggtccaaaggctgttgacagggctgagaagcccccagaggacccacatccctaggggcagggagggggcaagagaagcttcccttgagtttcctggaaggatcaggagttggactggcgaaggaggcaggtagaggaagacagagattaggcagaagcaggcagtggagtaagaacagggtgttggaggaactaggctgaggtctctgccatcaaagccagagtttagatttggtctcaataaacgggaagccctggctggatgtggtggctcacacctgtaatcccagcactttgggaggctgaggagggaggatcatttgagcccagtgctcaagaccagcctgggcaacacagtgcgactccgtttctaaaaaaaaatatataaaaattagctgggtgcgggcttgcacctgtagtcccagctactctccaggagtctgaagctgcagtgagctgtgactgcaccactaaattcctgcctgggcaacagagcaaaactctggtctcaaaacataaaaataaaatgtaaaataaacagggagccccgaggattccgggcaggagggggtgtggtcagcactggaattttagaagaagggcagttggtagctgggggaagggggttccacactggaaggagggggtccaggacttggacatggtataggatgtgccgcctgccagtgggacctaggacagcaggaccatcactgaggtggccacacggggaggggcaggaggggacaccctgctcttggagagaaagggggtgcccatccacccctgctgtatgaaggggaaagggggactctgaggcccagcgagagaggggacgggcccaagggatttgtggacagtgggggtgggggagaggggagcagagagcacagatagggacctggggcagatgtgagtctgggaggttcgacccctggctagactgtttccccaaagggtcctctgctccttgggctgtacgcactgcactgggcactagatacaggccagggcttagggcacggcggcgcctgtgggatcggggttgcaggcggcgtccagacccaggggcccctggtgaggggcgggcccggggagggggccataaggggctggctggggagggagggagggagaggccagggaagggacaggttccgagtggacgctgggtggagaggagagggagagtgggggcggtggggggtcgggtccgaggcggggctggtggggaggggggcatccgggggcgaatccgggtagggggtgaggaggcgggttcggaaggaatcgggcagggcccgggtgggtccggtgagtaagtgaggggacgatccccggaagggatcggggcgggtcggggtccggagatgggcggagcaggcgtcccgggagggtgcgcccaggagcggggcgagcggggcgagcggggcggtcccggagacgaggcgggtccggggagggggctggcccggggctgccccagcttggccgggcgcggagcggggcgcatggcgccgggcgcactgcgcgggggctgcgaacaaagggcccccggcggcggcgcgaggacggccgcgctcggaccctggccctggcccagccctggcccggccccctccccaggcgcggcgccccccaggagccgaaaaatgagcggcgccctgctctggccgttgctcccgctcctgctcctgctgctgtcggcgcgggacggcgtgcgcgccgcgcagcctcaggccccgtgagtatcctccggcgacagaggaggtcggtcgccttctggggtgggggtcgcgggtactggctcagagkgttgcagcgacctgcccaaggccacacagcctccgcgctgggctggacctggcctcttgttcccgaatcgtcttgaggagggggcgccctaaagtttccgaagtggctctgtggaggtacagggactcccaaaagctaaaggtgctgaggtcagctccccccgccccacctcgcccccttcgtgtgacccgggctgtcatcatgggtggcgatttccagttgtccaaggtatgaaggtaagaggagcgtcttggctgagaagtgggaggagagtgcgaaggggcactttcccgtgggtgggcgtggtgagggaggaggaagtgtttgttttgcttctacatttttctagaggtttgcttgcaggcttctggtgggttgacagcggggagaaggtgaattaactaactgctggggagtactgctaagttggcttcacagagaatatttctaaacctggcaagttcgggtgagctctgcagggctgcgggttcaggggggctgccctggtctgcacaagaccagccttttagtccagctgggcgtttagaaggcggcttgttcaagcagcccttgtttaggagtttccagaaaactggtaagcagtgagactaggtgggtgtcgttatttgcagtgagtagttggtccttgctggtcacagttttaaaagcaagacagtctactgcgctctgagcatccagacttccctctcctaggcttcgtgaaatcggaaccctacaaattttcatcctaatgcttctttcaaagctggcatcccttagaatagtggttctcagccctgggggggatttttgtctccctgaggccgctgggaaatgtctggaggtatttttggttgtcacaaatagggagaggcatttggtgttggcattaagtgggtgcaggccaggaatgctggtaaacagctttcgatgtgcaggtcagcttccactgcaaggaatgacgcggccccacatgacagaccttggctccaatgagagaccctgccttatacagaggtttttgtttgttgtttgttgtttttggggtttgtttttgtttttgttttgagatggagttttactcttgttgcccaggctggagtgcaatggcacgatcttggcttactgcaacctccgcctcccaggttcaaatgactctcctgcctcagcctcctgagtagctgggattacaggcgtgtgccaccacacccggctaattttttgtatttttaatagagatggggtttctccatgttagccaggctgttctggaactcctgacctcaggtgatccacccacctccgcctcccaaagtgctgggattagaggcgtgagtcaccgtgcctggcccgttagagagttttaaacagttctccagggcgttttcctctgactaaagtcaccctgtgatcttaccatctgttaagtgacatggaatccctgtgctgagagacacactggggaagagatgtccccaaatgaccgacctgggattccagattagctggcctctaagccaggggcatggttcacccagcccaaaggatctcgtcttaggaatagctctggatgcccacttctgtcacctgagagatttttgtgtgaggaatctctgatcccagaaagcagcacagtttgcagttgtaagagcaattctgtctacactgacccagacatccctttccccaatctgggaccttctgagaccagcaggatgagaagcagtgttggcccagatgctaggggtgggtcaggtgtgacagtgaatggctggcaagcatcccaacagctggaaacagctgcaacttctgaatggcagggaaacttaatttggtgatgtcagtttctctgggcagttggatgaagacttgaacccgtattgtcaggagtttcaaaggtgaccaagcaaaatgaacacgtattccttactctctcttctacactcaccatgtactatatgtgaggcccgtctaaactctagggatcagctgggagccagacagaaagagtattccccttttaaaggatgccacattccagtgctggagctggacaggacacctggacagggtaattgcatgtcctggtcagtgctggagttatgtaatacacagcacatacccagggtcttgcaaactccagttggtcctagagttggacagcacatgtgtgatcccaggggactgaactctggtaattattcaaggcagatgtagcacactatgatcacagggtcagtgcacactgtggccagggctgcagtaaacaacccaaacccattgttcgtgtgcatgaaacaacacaaacccactgcgtcttttgagatgcaaaattggtaatgatgttttcatgaagtttggtttatcagtgagttattttatggatcttatttttggtatcttactcaagaaatctttgcctaatctaagcatgcaatgactttctcctttgttttcttctagtgtttctacaagttttacttcttcaatttagatctgttactaagattaactttgagttaatctaattgcatggtgtgaggtaatgttctcaattcatctttttgcatgtggatgttgggttgttctagagacactattgaggccaggtgcagtgggcctgtaatcccagcactttgggaggccaaggtgcgcagatcacttgaggtcaggaggtcaagaccagcctggccaacatggtggaacccagtctctaccaaaaatacaaaaattagctgggtgtggtggtgcacgcctgtagtcccagctactctggaggctgaggcagaagaatcccttgaacctgggaggtggagggtacagtgagctgagatcacaccactgcactccagcctgggcaacagagcaagactcagtctcaattaaaaataaataaataaataaataaaaataaaaaaagaaaatattgaaatgaaaatgtctcctaatctcattgcatggtccagtttccccctttaccctcttttcttctgatttccatcattctacatggttgcaattgtggtgcctttgctataatgctcttggtgattgtggggacactgtaagcatttcatgaggttacagggcctttgtaattttccatggaaggctgcagatactgggagacmggagctcaggtggggaggacctgggccctcaggtcaggtcccctaagggcacctcagtgccctcttctgcctggctgtgtgatctggtgcatgttcctattcttctgaagcatcaacttcccatggggaaactgggggtaatgcctcccttccagaggtgacttcatagtcaatcagaagattttaggaaagagaggcctgctttgattccattgttttcagagctctttttgtttgaggccctatggtttgttttcagggtttgttcttaaaatgaatgttgcaaagaagccctttgcttctttttatcaggttttggagtctgaccgcctgagttagaatcctggtctgtcactgttgcggctggtgacttgacttctctggggtttcctttctgactttctaaatggggctgatgtcagcacttctcacrgtggtgggggasggggtgcaccgtgaggatgaagtgggatcctgccggttacctggcttgtggaggagagtatttcagacagtgggcatgacatgtgcaaaggtcctgggccagaagggccaggcgtggtggatcacacctctaatcccagaactttgggaggctgaggagggtggatcatttgaggtcaggagtttgagatcatcctggccaacatggcaaaaccctgcctctactaaaaagacaaaaattagccggccgtggtggcaggcacctataatcccagctacttgggaggctaaggcacgagaatcccttgaacccgggaggtggaggttgtagtgagccgagatcatgccactgcactccagcctgggggacagagcaacactctgtctccaggaaaagaaaaaaaaaaaaaggtcctggggcagaaggaagtagctgagtcaacaggctggaggccggaatagagagagtaagaggggttgtgcaatgctgaaaaatccagtgaggccagattcttacccagcatggggacttcacaggtgaaagagccaatccatggactcaagaactgatgggggggcacagactcctagagcatcaatgccagccaggtgtggtcagcaaaaggcaggagtctgctgcgaggagagccctgacctagctgtggtggcagcgagaccaggggtctkgggtgagaacttcacctcggatctcctttcctgcaggggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctgggtaggtcccttgggtgccagaccaggacttccccttcttttgcaaagtggagccacttgctggccttcagggctggggcagtgtgggtgttgctttgcttcccttctgccctaaatccccaggggcatgggagggagggagggaagacaggttgcattctcctcattctacagatggagagagagtaaagcccaggatgggcagctcagctcatgggtcctcagcagccctggttctgtgggtgcagatctgggcagagcacgggcacccacctgtgtcagctttgaccagaggtgggacaggggacctgaaggagatcacatgacccccctctgaccttttgttgggtttccagcacacctgaaccattagactcagacctgggctcacaggcctgttactaagtgcagctcaggccctcagccagtctctccccttcactccttggtcaaatgcagacagcaacagcctcagcctcctggtcaagatagtgaatgcagatccctggctcagaaagctgtaatctcccaggggaggtagactcattcctcatgccgagaatgatgtagccacaggagacacagagaaggccaggggctccaaggccagtgaagcagcacttgtctcttagggaggtgtggccagagaaggtggaaatgtggaagcttctagaaccttctagaagcccttctagtcctagaagaaccaggcactcctgacttgggtggctagccaactgaaacccaacccagttggcttctgcaacagtttgtggtctctcatacctagaaagaaagtccactggtattgctggccagcttctccccctacctcttgatgcaaccaggtctctccttaagatcaggggaagcaccagtytcccaagatggctggataaagtcccaggattccctctgattggcctatcttggttcatgtgctcaaccctgagccaatcactatgaccagaggggaaggcctatgctgattggttcattttgggtcatgtgctcagccctgaaccaatcactgtgaccagggggaaggcctatgcagattggctcagagtcccaggaaggyggatggagagcttgggagccacgtgcgttgtgtgctgggcagatagcttgtccaaggaaattgaggatctgttagcaggaaatgggataatggttgctgggaggcaaaaataatagatacctaattgagtcctggaggccagaaacctagtacagtagcacaaatgatttagtgtgggtagcagagagaggtgatgggagaacagtcaggtccactggggacctcagtcccctcttctttctctccacccttctccttgttcctctcccctggtgttttcccattactcccctcacagcttagtttggacaggagccaggggtgaagtaaatcaagtacttaggcaggccagctttgccctgaatagctcagctttgtccattccctctggccttcagcttgtgccagcttggaggaaacctctggcttctgccagtcctagcctggcccagtccaggccagcatgacccagggtgtgtttgtccacatgaaacccctttgggttaagaaagtttgtggtttgtgaggctgcagctcagggaggcagggcaacacagctcttgatttaacttttttcattttattttcatttttagataaagggacaatcaaactcaaggtaagccgttgatttttaaaatcataaacctgaccttggaaataaagaattgaattgggccaggcgtggtggctcacacatgtaatcccagcactttggaaggccgaggtgggtggatcacctgaggtcaggagttcgagatcagcctgggcaacatggtgaaacsgcatctctactaaaaatacaaaattagccaggcgtggtggcacatgcctgtaatcccagctactcgggaggctgaggcaggagaatcgcttgaacctgggaggcrgagratgctgtgagccgagattgcaccattgcactccagcctgggcaacaagagtaaatctccgtctcaccaaaaaaaaaaaaaaaaagaaaagaaaaaaaaaaaagaattgaattgggatggaataagagaaattgcatgtgttgtgagaaaaatcatttttaaaaaagagatgtaaaaaatgaataatgaggctgggtgccatgctcacatctgtaatcccagcactttgcgaggctgaggtgggttgatctctggagcccaggaattcaaggccagcctggaaaacatggtaaaatcctgtctctacaaaaaaaaaaatacaaaaattatccattagctaggcatggtggttcacgcctgttctcacaaccacttgggaggctgaggtaggaggatcgcttgagactgggaggttgaggctgcagtgaactatgatcgcaccactgcactccagcctgggcaacagagtgaggccctatttaaaaaaaaatgagagaataatgaaatttagaaaaggagaaatccaccgataatccagttttcatacttttcactttttcatgttttccacacattcttgttcatgcacatacattttcttttcatagtttcagttaaaggacacacaccactggccgggcgcagtggctcatgcctgtaatcctagcactctgggaggccgaggagggtggatcacctgaggtcaggaatttgagaccagcctggtcaacatggcaaaaccccatctctactaaaaatacaaaagttaactgggcatggtggcgcacacctgtaatcccagctactcgggggctgaggcaggagaattgcctcaacccatgggacggaggttgcagtgagccaagatctcaccacttcactccagcctgggcaacagagtgaaactccgtctcaaaaaacaaaacaaaacaaaacataacaaaagaaaacaaaacaccgtggtgtttcctagtccctcttatcacactgttgtaaacaacttccatgtttccaagtctctgtaattggaatttccatttcattgtaagcagcatcctattgcacccctcttaaatatcagtttgctaagcccccagctagattttttctagattgtttcagtggttttttttttcttttttttttttgagatgaagtctcactctgtctcccaggctggagtgcaatggtacaatctcagctcactgcaacctctgaccctggtttcaagcgattctcgtgccccagcctcccaagtagctgggacctcaggcatgcaccatcaagactggctaattttgtgtgtgtgtgtgtgtgtgtgtgtgtgtgtgtgtgtgtatttttagtagagatggggttttaccatgttggccagactggtctgaaactcctgacctcaagtgatccacccaccttggcctcccaaagtgctgagattacaggcatgagccaccctgcctgggctgttttcagtgttttgatactgtaatccttaagtcgccagaatgtttgtatgtaaagccatattagcattctggatgccttctttaggctaaacagccaaattgaagaattaccagcaggacccaagcctctcactgggtcttgctgtgtcctggaatacrcagcagtacctgttcatggaaccacctgcagtacattagggatcagatttctccactgcctctcagacattgaatattgttatttttaaattattatatgtaccaaactatgtaaataattttatgacatgggttttcaaactggagtccttggatttcagatattatgtaagccctggaattgcggcatttggggggttagctattccttaacttttaccacatgctcaaaggagtctacgaatgaatgggstaaattgagaattattttaaattataaggcgcccatctccattgatcagaatggaggctgagatagttccttttgtatgaggtataccactagtgcctatttgctgcaggacagtggtcttcctgccttactttttttttttttttttaagcagtcttgctttttctcccaggctggagtgcagtgatgcaatcttggctcactgcaacctccgcttcctgggttcaagtgattctcctgcctcagcctccccagtagctgggattacagrtgtgcaccaccgtgcccagctaatttttttgtatttttaatagagatggggtttcatcatgttggccaggctggtctcaaactcctgacctcagttgatctgcccacctcagccctcccaaagtgttgggattacaggcgtgagccacagcacctggcccctccattacatttgatgatagaaccctttctctaaggcagcagttctcactcaagggggcttttgccctacagggcacatttcgtaaagtttggagacatttttggttgtcacagctgggttggggctgggcggtgccaggtgctactggcatctggtgggtggaggccacagctgcaactcaacatcttacaatgcgcaggatcccttacagcaaagaaggatgtggccccagaagtccacattcaggaaaccctgaaccaaaaccctagagcagcagtccccaacctttttggcaccagggaccagtttcatggaagacagttttttccacggaccagggagcagaagaaatggtttcaggatgattcaagggcattccatttattgygtgctttatttctattattattacactgtaatatataacgaaataatgatataactcaccataactgaagaaacagtgcaagccctgagcttgttttccttcaactagatggtcccacctgggggtsatgtgagacagtaacagatcatcaggcattagattgtcataaagagcatgcaatctagacccctcccatgcacagttcacaatagggttcwcactcctatgagaatctaatgccaccactgatctgatgggaggcggagcttaggcagtaatgtgagtgatggggagcggctgtaaatacagatgaaggttcatttgctcacccactgctcacctcctgctgtgtagccccattcctaacaggccattgactggtaccagtctgtggcccaggggttgagggtccctgccctagggcttcaatgcctacagaagcataaggaaaaaagaaaaaaaaaaaaagaccctagaactccctttcctggcttcctgtgattggatttcttttcctccctcctcccttccttcctctctctctctcctgcctttcctttgtgtgattagatttttctctctctttctctctttttggagacagagtcttgctctgtcgcccagggtggagtgcagtggcacgatctcagctcactgcaacctctgcctcctgggttcaagtgattttcctgcctcagcctcctgagtagctgggactgcagacgcccccaccatgcccagctaatttttgtattttcaatagaggtggggtttcaccatgttggctactgtggtctcaaactcctgacctcaagtgatccacctgcctcagcctcccaaagtgctggcattacaggtgtgagccactgcacccagcctagatctgctttcttatgagtcaggaagccatttccctggagcaggtgttaagatgatgtgcagtccctggccaccacacgttagaagacactcttcacagcacagatgctgggaatttgtaagagagactaacaaagggttgtataattctgggagaggggccaagggctcttaagactagacttgagattcccaagaaagatgcttaagatccttagcatttggccaggcacagtgactggtgcctgtaatcctagctacttgggaggctgaaactggaggatcgcttgaggccaggagttggagaccagcctgggcaacatagttgagagcctgtcccctgtctctacaaactgaaaataaaaaattagccgggcatggtggcctgcacctgtagtcccagccactcagtaggccaaggtaggaggattgcttgagtccaggagatcgaggttgcagtgagacgtgatcgcaccacagcactctagtctgggcaacagagcaagascctgtctttaaacacggaaagaaggctggaggtccttcttgccttctctccctgtgggaggcatcctcttccctgggaaggtgtgaagctctaggggctgccgtttggggtcggccccctttatgtgctcagcatagtctcttgcccgccagcctccctgtccctccagcatacggtcctcagcacctccrgtatctccctcctgcccatccttgccctgctcttgggtggccgggacctttcctccctcttcagcctctggccagtgttgagatatttccagaaacagggccaggtgaggattttgggattggagtagtgggtgaggtttattgctttggttggtcttgacggggaaactgcagtcagaagagacctcacaggtccagaaggctgstcctgcgggtggcaggtaggagaggtccctctgaggctgttcagagcagacaggaggtgggtggctggagagagggctgggacggaccccgtgtggcttcagagagcgggggtcctagtgcaccccgacctcacccacacaatggtcatgacagtgcagaactgtgatgatcagtcagataatctggtagattgttccccgtgatggtcaccagggtccatccaccccttgagggaccacatgagtagatgctgacataggggtcctcagaagaggaacaccccacagttggatagttttatttttacattttttttattttttattttttgagatggagtctcactctgtcacctaggctggagtgcagctgtaccatctcagctcactgcaacctctgccttctgggttcaagcgattctgctgcctcagcctcctgagtcgctgggactataggcgcctgccatcacacctggctaatttttgtattttcagtagagacggggcttcgccatgttggccaggctggtcccgaactcctgacctcaggtgatctgcccacctcagcctcccaaagtgctgggatgacaggcgtgagccactgtgcccagccatttgggtggttttaggaacaggtgggtgcacatagctccccaggtgatctgcttggaggtaatgtccacctgctgggtgcccagggatggctgagagggtaactatcatcaaataccggtcacatagagggaggtaatatggtttggttgtgtccccacctaaatctcatcttgaattgtagctcccataatttccacacgttgtgggagggacccagagggagataattgaatcatggggtggtttcccccatactgttctcatggtaatgaataagtctcacaagagctgatgattttataaggggaaacccctttttgcttggctctcattctctcttgcctgccaccatgtaagacgtgcctttcacctttcgccatgattgtgagacctccccagccacgtgaaactgtgagtccattaaacctctttttctttataaattacccagtctcgggtatgtctttatcaccagtgtgaaaacagactaatacaggaggcattacttttgtttgttttaagcatgaaaggagcttttatagtgcatgactcacatgccagggcgttctgcccatctgcttaaaaaaaaataagaggacggccaggtgccatggctcacacctgtaatcccagcactttgggaggctgagtcgggaggatcacatgagcccaggagtttgagcccagcctgggcaacatagtgagaccccatctctaccaaaaaataaaataaaataaattagctgggcatggtggtgcatgcctgcagtcctggcttctcagtaggctgaggcaggaggatcgcatgagcccaggagtttgaggctgtagtgagctctgatcgcaccattggactccagtctggcgacagagcaagatattgtctctaaaaacaaaagaaagaaagagaaagagagagaaagaaagaaagaagggaaggatggagggagggagggagggaaggaatgtgtagtgtaggaaggatggaaggaaggaagaaagaaaggaagggagggagagagggagggagagagggagggagggaatgtgtagtgaaggaaggaaggaaggaattgcgtagtgtaggctccatcctgaagactgaagtggtttttttttttctcccatctgtgtggcaaaaacacaaaccaaaccaacaaaaaagccatctaaccattctaaaacatataattccgtggcatttactacattgacagggttgtgcaatgcccccccatctagttccagaacatttttatccccgcaaaagaagaccctgtccccatcagtagtcactccccactcccttctcccagcccctagcaaccacccatctgattcctgtctctgtggattgccttttctggacaattcagatcaatggagtcatgcactatatatgtgttgtgatttttattttattttattttattttattttattttattttattttttgaggcggagtctcgctctgtcatccaggctggagttcagtggtgtgatctcagctcatggcaacctctgcctcccaggttcaagtgattggtgtgcctcagcctccagagtagctggaactacaggtgcctgacacacacctggctaattttttttgtattttttgtagagacagggtttcaccatgtcggctgggctggtcttgaacttctggcctcaagccatctgcccacctcggcctcccgaagtgctgggattacaggtgtgagccatcgcgcctggcttgtgctgtgactttatttgtattatttgtttatttattttttttggagatggagtttcactcttgtcacccaggttggagtgcaatgttgcgatctgggctcaatgcaacctctgcctcctgggttcaagcaattctcctgcctcagcctcccgagtagctgggattacaggtgcccaccaccacacctggctaatttttgtacttagtagagatggggttttgccatgttggccaggctggtcttgaactcctgacctcaggtgatccgcccaccccagcctccccaaagtgctgggattacaggtgtgagccattgcrctcagcctgtgctgcgattttagagtgaggcaracacagacacatatacatgatagatatatctggacatgtacatatgtatatcaagggatccaggtctccttccaccgctcacaggctgtgaattcacttggcaagaagggagacagttcttgtaactctccagtgatgatgacagaaaacagctttgcaactctgttgagtcagaagagaaggctccataactagaccagtgtttctcagcctcagcatggctgaaagctggggcaggcttggcacagtggctcacgtctgtaatctgaggctgaggtgggaggatcgcttgagcccaggagtttgagaccagcctgggcaatagagtgagaccttgtttctaccaaaaataaacaaaataagcctggcttggtggtgcatgcctgtagtcccagctctttgggaggctgagatgggaggattgcttgcgcccagcaggccaaggccgcagtgagccataattgcaccactgcactccagcctgggcaacagagataaaccctgcctgaaaaaaaaaaaaaaagaaagaaagaaagaaagaaagaaaaaagatatggccgggtgcaatggctcacgcctataatcccagtactttgggaggctgaggcagatggattgcttgagcccaggagttcaagaccagcctggccaacatggtgaaaccccgtttctactaaaaacataaaaattagccaggcatggtgacacacacctgtaatcccatctactcaggaggctgaggtgggagaatcatttgagctgggagacagaggttgcaatgagctgagatagtgccactacactccagcctgggcgacagagtaagccttgtctccaaaaaaaaagatatttggggcagtttgccaagggcgggggtgtcctgtgctctgtaagatgttgagcagcctctctattcccctctcaagtgacagtagcaatccccacccccaaagctatgacaccccaaaacatctccagaaactgccaagtgtccccctggggcacagtcactcctggggtgagttccccctgttccaggcctccaaactccttycccagtatcttggcccattccagggtgaattcttgtcccaaagctccttcctctgcctgcaggtgcccacgggcctccggggccaagcgcttctgaaagtgtggggccgcggctggcaggcggaggaggggcccctctttcacaaccagacctcggtgaccgtggayggccggggcgcttctgtattcatccagacggacaagcctgtgtacagaccccagcaccgaggtgagtggccagcatggatgcagggagggccggccatggtctggaggtgtcacacgcctctcttctttcttctagtgctcataagcatcttcaccgtctctccaaatctgaggcctgtcaacgagaaggtgagatcagcttctaaaaccgcgggcccggagtgcacccacttgggactacctggccagggccaccatcggaaacgggtctttctctccagaacttctcttttctattttctttcatggttgtttcatgtcccccggagaaccccagggagttctttgtgacagaggaaggctggtgggcgtgcctggcccactgcccctcaacaaggaatgcctttgagggctttaggtagccctggactgttgcttaatttttttttttyccccaagaccgagtctctcgctctattgccaatgctggagtgcagtggcactatctcggctcactayaacctctgcttcctgggttctaagtgattctcttgccttagcctcccgagtagccgggattataggtgcccaccaccacgcccggctgatttttttttctgttttttttttgagatggagtcttgctctgtcacccaagctgaagtgcagtggtgcgatcttggctcactgcgacctctgcctcccgggttcaagcgattctcctgccttagcctcctgagtagttgggattacaggtgtgtgccaccatgcccagctgatttttgtatttttagtagagatggggtttcaccatgttggccaggctggtttcaaactcctgacctcaggtgatacacccgcctcagcctcctaaagtgctaggattacaggtgtgagccactgcacctggctatatttatgtgctttctgtctagcgctctctctctgtctgtatatgtatatatacttacaaaattattttaatggtaaataatgtgagaataacttacagatactgtgcctctctggccctgaacacttggcctgtatcctttaagagcaaggacgttctcttatacaactcaaggaggatcatcacatttaaaaattttgaggctgggcacagtgtctcacatctgtaatcccagcacttcgggaggctgaggcaggaagatcgctgtggccaggagtccgagaccattctgggcaacatagcgaaactgtcttgacaaaaaattaaaataataaaaattagttgagcatggtggcatgtgccagtagtcccagctacttgggaagctgagtcaggaggatctcttgagcccaggagttcgaggctgcaatgagctgtgattgtgccacttgaactccagcccgggcagcaaagcacaaccctgtctctacaaaaaacgaaaaaccaaaaaaaaaagaggaggaaaataattttgacattgacacaataataatatctaatataaaatccatgttgttccaatagtaacctttatagcatgtttctttgctggtccaggatctgatcgtgggtcatttgttgcatttgatcatcatgtctcttggtctcctttaatttgaattagttcctcactgcctttctgtgtcttccatgacattgacatttttggcaagtccaggcagttgttttgcagaacgccccttggtaggatggtctcctggttccttgtgaccaagttcagtctgtgaatctcgggcaggatccacagaagcaatactggatcctccccggtgccttgtatcaggaggcacccagcatgggtttgtcgtgttgctggggacattaacagggtccagtggttcaagtagtgcctgcctggtttccccatttcttttttttttttttgagacggagtctcgctgtgtcacccaggctggagtgcagtggcgcaatctcygctcactgcaagctctgcctccygggttcatgccattctcctgcctcagcctcccgagtagctgggactacaggcacccacgaccatgcccggctaattttttctattttttgtagagacgggatttcacggtgttagccagggtggtctcaatctcctgacctcgtgatccacccgccttggcctcccaaagtgctgggattacaggcatgagccacctgtaatgagtctttctaaagaccctacttggggttaggattcaacggatgtaatctagggggacactgtttaacccataacagcgactgcctgtcccggggaccgaggccatgcatgagcatgttgaaagggtttggggtttgctggaagatttgctcactgcatctgtgtcttcattacagctggaagcctacatcctggtgagtggcctctgtccttcctcggcttggacttggggcccgggtagcccaccttctgcaagatctggtctgtcttcgctcactgtctgccttctgggttgagccgctgtgccttacaaggctgggacctggcctcttctatcctggtccctgggtccgccctgggatgggctgtgtgtgtgtctgtccgtttcctttttttttttgaaatggagtctcgctctatcacccaggctggattgcagtggtgctgatcttggctcactgcaacctctgcctcccgggttcaagcgattctccttcctcagcctcccgagtagctgagactacaggcrtatggcaccacacccagctaatttttttttgtrtcttttttagtggaaatgggggtttcaccatgttggccaggctggtctcaaactcctgacctcaggtgatccgcccaccttggcctcccaaactgctgggattacaggtgtgagccaccacacccagccacgtccatttctaggtttgtacacggctccctaaatgaggaggtaggcccagcccrtccccttctgcttttcaaatccttctctatccagagctttttttttgccccggggttaatgattaatcttgggaccttcgctgcatggttgacatgcccaagagagaggactgggaaaatccttacattgggcacatgctaggctagcctgagttcactccgtgtgtctgtccccctccaccaccaacaggacccccgaggctctcrgatgatagagtggagacacttaaagccgttctgctgcggtaagtttcttcctctgcggcttgggggctgcagatgtgataaaccttccaggaaaacagaatatgctctgtccagggcccaccgctaatgtacccccactgctgctccagctggaggggaccaaggaggagcggagggcaggtacccacctgggaggtgacaatgccatgggtttggatctgggagcctcagcccagcccacagcaccttccctgtggatttggaccctctgcccacrtttctctatgcccaggactcaggcggggctcctgctcagaactcaagacctttgtggaatactggggcacctgctctcaccttgttttttattttttgagacagagtctctctctgtcacccaggctggagtgcagtggcacaatctcagctcactgcaacctctgcctcccgggttcaagagcgtctcctgcctcagcctaccgagtagctgggattacaggtgcatggcaccacgcctggcttatttttgtatttttagtagrgatggggtttcaccatttggccaggctggtctccaactcctgacctctcaggtgatccacccgccttgtcctcccaaagtggtgggattacaggcgtgagccaccacgcccggcctgctcccagcttcttcctgctataggttgcagattttatcatccccattgcatgagatatttcttttccagctagaagtcagaaaggactttgcttttttcttttcttttcctatgactaggaagactgtgtaattgacataccccactttgctttgcctgtgaggggtgtgatgccccaggagagggcaggggataggtagggtgtggggagtctggggatggccatgcacacacccaggctgtccagaaatggggtaacartagagccacaggcaggatcacgggggtctgttggtgacccttcctccttctgtctcctgccttgggtctcagcctcttttcttcttcttcatcttccttctttcttgttctttcttcttctccttctcttcgtcttattctccctcctcctcctccttcttcttcgatcttccttcttctttcctcctcctcctccccctctcctcctgcttcttcttcctccttcctccttcttctttcttcttcttcctccttctcctttttcttttcttcttcttctttttttttaaaatacagtcttgctattgtcacccagactggagtgcagtggcacgatgtcggctcactgccacctccgcctcccgggttcaagccattctcctgcctcagcttcccaagtagctgggattacaggcacgtgccaccaggcctggctaatttttgtatttttagtagacacagggtttcaccatgttggccaggctggtcttgaactcccaaactcaggtgatccgcccgcctcggcctcggaaaagtgctgggattacaggcatgagccaccgtgcctggcctcagcctcttttcttctgttccatcttccctgtctgccttctttactccctctcgttcccttgattgctgtctttgtatcagcagctatttgttgggcgccacatagatactgccatggggtgagctttcaacccaatgggggaagcaaacatgaactaaacagcctggataatgtcagttgtgatgagtgctaggaaggagaagttcaaaactcagagatggcaaatggggctctatcccagcccggggtggcagaggcaatcctggaaggctgcctgaaggaggatccttttcagcaacaaagaaggaacgggggacagccaggcaaagcaagggggccaggaagcatctcccaggcagggagtcaacttatgggaagggctgtggatgtctagggtagtgaggttggagatgggggacaggagagagatgttgagtgctgagagcaggggtgacactggcaagagccagggaagagaatggatttgatctttttttaaaaagttttttttttttttctcaagaggcaggttctctctcattctgtcacctaggctggagtgcagtggtgtgatcatagctcactgcagcctctacctcttgggttcaagtgatcctcccacctcagcctcccaagtaggtgggaccacaggcgcgtgccaccaagcccagctaattttttaaatttttggtagagacagggtctcaagatgttgcctaggctgacttgatcttaagagcacagagttggggaagaggtcaacctcctgtttaaaaaaaccctttgaggcctggcttggtggctcacacctgtaatgccagcactttgggaggctgaggcgggcagatcacctgaggtcaggagttcaagaccagcctggccaacatggggaaaccctgtctctactaaaaatacaaaattagctggacatggtggcgggcgcctaaagtcccagctactcaggaagctgaggcacaagaatctcttgaacccgggagtgaaggttgcatgagctgagatcatgccactgcactccagcctgggcaaaagagcaagactctgtctcaaaaaaataaaaaaaaaaaccctttgggatgtgtgtagacccatgattctcaaccagggtgactgtgcccctctctcagggagcacttggcaaagttggccacagaccccttacaaaacacgtgctcaggacacacatccccgaatgtcctgtaaccatcaaaggcccactttgcctgaatatgagggggaaaaagccrttttagccatcacatcttctgactccaatgtgattgagagaagccgtgggcgccgctatgggttttcggttctgtcgtgagacccaggggaaccactctccctgtcccttccctgtatggccctccccatatgatcattggggacgagtggagcgtgtcacactcaggagtggaagatcccctggcactgcctagagtcaatgtgccctttccaactcctccatggctcccagtgaaaacagctgcggacggggctcagaggcacaggcgcaaagcaaatgacagctcccatgtcagcggctgatggtgtttctggggggatgtttggggagagagtgctctgttctaargtgtgtgcgtgctctagttcagttggggggtggttctcatggaggggtggggggtcggacaggcgattctgcccccaggggacatggcaatgtctggggacattttggcttgtcaggacttttgtggaggacaaggggtgcaactggcatctggtgagtggaggccagggaagatgctcagcacccctcagtgctctgggatttccaccaaggggtgactttgccccctaggggcgatattggcaatgtctgggggacttttttaggttgttatattgtagagggcattggtactactgacctttggtgagtggaggccagggatgatggtcagcacccctcagtgcacaggatgcccccacaccacaatgaatgatctggccctaaatgtcagtagtgctgaggctgagaaaccctatcctggcaggagaccctgtctgtcttgtctgtttctctctctctctctctctgtctgtctctctctctctctgggatttccacccaggggtgattttgccccctgggggcgatattggcaatgtctgggggacttttttaggtcgttatattgtggggggcattggtactactggcatctgttgggtggaggccaggggtgctgctcagcatcctacagctcacaggacacctccaccccagagrgccacgtggccccaggtgtcagtagtgcccaggctggaaatgactcgggtggcgggggatggagtgaatgagccgggctggctcatttccctcgtttgtccagctcactgcctgcccctggccctggctgcaaggctgtcccgggaaccgcgggtccagtcccttcctgcatcccttcgaagccygccggggtgtcaaacctgctccgctggcctgatcctacagggtgctgctctgcacagaccccgccagcttctctgtggtctccagttctcctggggggctgctcagggaaggagaaggagcagggtcctggctccctcttcccgtacctcaccgtgtctgtggctctctgaaaaagcccttgccctctctcttcacacaggcatcaccaacatgagcttccccttgtccgaccagcctgtgttgggagaatggttcatttttgttgaaatgcaaggccacgcgtacaacaagtcttttgaagttcagaagtatggtaagttggagaatctcagggtcttgggatttcagatctgggagaaaccttagaaactggtgaagaaggccgggtgcaagggctctcgcctgtaatcccagcactttcggaggcccaggtgggcggatcacttgaggtcaggagtttgagaccagcctggccaacatggcgaaacctcgtgtctactaaaaatacaaraattagccgggcgtggtggcgcgcacctgtggtcccagctacttgggaggctgaggcaggagtatcacttgaaccgggaggcagaggttgcagtgagccaagatcgcactactgcgctccagcctgggcgacagggcgagactctgtctcaaaaaaaaaaagaaaaagaaaaggaaactggtgaagatggcagtgaagaggtggaggatgacatgagtccccgtttactgagggctcatgatggctgggtatagtttcaggggatggtcctacactcttactttttttttttttttgaggcagggtttcacacccatcacccaggctggagtgcagtggtgcgatcttggctcactgaagccttgacttcccaagttcaagtgatcctccctcctcagcctcctgagttgctgggactacaagtgtgagccaccacacctggttaatttttgtattagtagagacagggtttcgtcatgttgcccaggctggtctagaactcctggtctcaagcaatccttccgcctcagcctcccaaagtggactcttgccttttatagaaaaaagtattgtaggccaggcatggtggtggctcacacctgtaatcccaacactttgggaagctgaggctggaggatcgcttgaggccaggagtttgagaccagcctggacaacatagtccctgtctgtataaaactttaaaacaattatctggacatggtggcacgtgcctgtagtcyccgctactcgggaagctgaggcgggaggattgcttgagcccaggagatcaaggctgcagtgaactgtgattgcaccactattctccagtttgggtgacaaagtgagaccctgtctcagaaaaaaaaaaaggtggccaggcayggcagctaacgtctgtaatcccagcactttgggaggctgaggtgggtagatcactagaggtcaggagttcaagaccaggctggccaacatggtgaaaccccatctctactaaaaatacaaaaattagccaggcgtggtggcatgtgcctgcagtcccagctacttgggaggctgaggcaggagaattgcttgaaccaggaggaggaggttgcagtgagccaagatcgtgccactgcacaccaacctgggaaacacagtgacaatctgtctcaaaaaaaaaaaaaaaagaaaagaaaagaaaagaaagaacgaaaagattcttaggctcctacaagagttctctcaggacccgattctttctggtttacyggctgctccagggtgtcacctccgcccctggtgacaagatggcttgatactcccagggctgagtccagaagcaaatggagaaatcagctctctgttgcagtcacsctggggatgccccttgttggctcccagggccacctctatcccatgcacagacacaggggctgggaggagcctcctggcctcgtgtccaccctgggataggctggaatccgccacactctaagcacgtggtctaaaagtgacagggggaggccccttgaggaaaatggggtcctagtcccccaaagatgagaaatagatgcagcccacaaaatccccagggctgctcagcagagtggtgtggatgggtacagtgtcaacctcggtggtggccaggtgctgtggtcctcagacaccttgcaccggtgtcagggctcctgaggccaccttagggacagaagccagcccctcctctctgcttgctttcttcagtgttgcccaagttygagcttctgattgacccgccccggtatatccaagacctggacgcctgtgagacaggcactgtgcgggccaggtgagaaagagggacccctggggcacactgggggggcccttccccttccccaaccatcacgctgctccctcaaggtcgttcccctcctctgctgcctccctccctcccacatgggtgtgcccctcccttcctggttccctcctccctggggtgtacccctcccctagtgcatctcccttcctgtgactctctccwgtaggcrccccctcctcaggaggtgcccctccccctagagtatctccctccccrccaggctcctcccctgtgggcgcctcctccctggggtgtccccctccctctaaagtatctccctccctgctgggctcctcccctgtgggttcccctccccaggatgtgcccacccgctagagcatcatcctttcccgtgcccctcccctgggggcaccccctccctggagtgtacccctctccctagagcatcttcctccccctgggcccctcctctgccctccccttccatctcccccaacaaccgggcttccccctcctcctacaggcagacacttcttccatggcctccctgctcccacaagggtgccctgtgccccgctccctccctagtactcggtgtctccctgccacatgagtctcttgcactctacccactgcctgtctttgtttccatgctggtgtcctcacccctatgagcacgcccctgtctctccaaagcatgcccctctcccgctgtgtattccttcctcaagtcctgcccttccactctaagttcttccctccccaagggtctcccctccccaaagaatgccctaccccccagggtgtgaccctcccaaccccaccatgttcccctctcccccaaggctgctccccgccctctgcaggcctccctggcatccaacagcacccccgccagtgtgctgacccgagaggggttgatccttgttttttttttttttttttttttttcagacggagtcttactctgtcccccaggctggagtgtagtgacagtctcagctctctgcaacctctgcctcccgggctcaattgattctcctgcctcagcttctcctagtagctgggatcacaagcatgtgccaccacacccaactaatttttgtatttttagtagagacagagtttcaccatgttggccagtctggtctcgaactcctgacctcaagtgatctgcccaccttggcctcccaaagtgctgggattacaggcatgagccaccatgcccagcctgcactctctcattttgctcctgttccccatccaccagcattccctctgcatcaggagtgacatacagacatttaagtttcactatcacccctgagagggtagtttgagtcccattctctgggtgaggaaacaggctcagagaagttcggcccttggttcaaagtcgagcttaatggggcgcttaggctcaggtgcctctcagtcgctcatgcctctgcactactctgctccagaggtggcaccaacctagccttctcagttccagagttcctctctgacccttggtctctttttctgtccatctggaggcttggtgcagaggatcggagggccttggcatcttctgtcccgattccaggctgcagggagggctgtcaggacaggatgcagggtgtggaggragctgcatccatcactgtactagtggccacactatgycaacctggccttcctgaggctgggccctccctgccatcttggctgtgaaattgagcatgctttatccttttgttccaggtatacctttgggaaacctgtggctggtgccttaaygatcaacatgactgttaatggtgtrgggtactacagccacgaggtgggacgccctgtcctcagaacaaccaaggtgagaaacagggaccccttctaccccctgacccaacccccaggttcacctccaccagcacacattttattttactttctcttattgttattattttatttactgcctttaaaaagtttttgaatagagacaggatctcactatgttgcccaggcttgtcttgaactcctgggctcaagcgatcctctcgcctttgcccccaaaagtgagccaccgctgttttactttctaaaacagttatatggcagggatttttctgatgataaaattcctgcaggctgaatatagagactttagaaaatataaaaaggaagaaaataaagataacttgttctccaataggtggacatgaccactatcgatattttgatgtgtttcctcacaggttattgtaagtaaagttaaaaaaacaccaatttggctgggcatggtggctcacacccgtaatcccagcactttgggaggccaaggcgggcggatcacttgaggccatgaattcgagaccagcctgaccaccatggcctgggcgacaaagtgagactccatctcaaaaaacaaacaaaaaacaaaaaaacactaataaacactaattttattgcctggagtcccagctcttaatatttggaaggtagagacaggaagatctcttgagctcaggagttcaaggccagcctgggcaacatagtgagatcccatctctaaaataaaataaaaacataaacaattttattgagatatcattcacatagcatacaattcacccatgtagagtgtacagcttgatggttttcttttcttttcttttttttttttgagatggagtcttgctctgttgcccaggctggagtgcaatggcgtgatctcggctcactgcaagctccgcctcctgggttcatgccattctcctgcctcagcctccccagtagctgggactataggtgcccaccacaacacccggctaatttttttttttgtatttttagtagagacggggtttcactgtattagctaggatggtctcgatctcctgacgtcgtgatccgcctgcctcggcctcccaaagtgctgggattacaggcatgagccactgcgcctggccacagcttgatggttttcatatagttgcagagttgtgcaaccatggctgttatccaattttagaattgttccaccatccttccatacatccttcatgtccttttgcagagaatcctcatttccctcctcctgtctctggcaactactatctgttttctgtctctgtagatttgcctgttctggacatttctgtgaatgaatcatatgctatatgtccttttgtgtctggcttctctcactcagcatcatgtttttgatgtttgtctacatcgtagcatgatcaatgcttcattccttttttatggctgcatcatattccctggtacagatggaccacaatgtgtttatcccttcatccgctggtggacatttgggttgtttctgctttttggctattatgtctcatgctactatgaacatccctgtgcaagtttttctgtggacctacatttttgtttctcttgggttctttcctaggagcggaattgctaggtcagagggtaacactatgtgtgaccttttgaggaactgccaaatggtcaatgtggctgcactattttayattcccacctgtttaaagttttgtaaccttttttggtctttcagcataatgttacattgtgagtgggctacagtacaacagacacccaccttcctggagattcccatccctctgtaggtgcccggacattaagcctttcagcaccggctcctccccacctcccacccaaagctccttctcagtccctttcccacctgrgacacatctgctccaatgggctcccctctcttatgtctgagatatctttaatttaatttaatttaattaatttatttattgagatggagtctctctctgtctcccaggctggagtgcagtggcacgatcttggatcactgcagcctctgcctcctgggttcaggcaattctcctgcctcagcctcccatgtagctgtgattacaggcatgtgccaccgtgttgggataatttttgtatttttagtagagacagggttttgccatgttggccaggctggtcttgaactcctgacctcaagtgatctgccgctgctggccttccaaagtgctgggattacaggtgtgcaccatcacacccagcccatctctctgctctctgaggcttctcttccatggattggaaaccataaacccctacctttcccattcctgacactggcaccttggagaatcccagccattctcctgggaggctaccagctgatggtctttgacttagttctctcatttacggagtaatttactccacagctctttctgaatgaggattatttgccaagtcccagggtgggatcctgagataggaattgaatgagggagttctggtgccccagagtgaggctgagcaggttcagctgccccctctgttgcctgggctgtgggagattgtgtcagcatgggaatctctttcctctttttttttttcttaacccaggctggagtgcagtggcacaattcaggctcacctcaacctctgcctcctgggttcaagcgattctcatgcctcagcctcccaagtatctgggattacaggtgcctgtcaccacgcccagctatttttttacatttttactagaggcggggtttcgccatgttggctagactgatatcgaactcctgacctcaagtgacccgcccgccacagcctcccaaagtgctgggattacaggcgtgagccaccgcacccagcctctttcctcttctgcccaatggagccaacatccatcttccctgggatgttgtccagatccagtgagggaccctctgcatggtcccgtggcatagaytgggtatgccaccaagtgacccctggccctccaagcagctgaagagtcttgcacctcaggtgtgtgtttcagggacatccctcaaagacactccaaccctgagtgagcacgggctgtgtttttcctccctccagatcctcggctccyrggacttcracatctgcgtgagggacatgatcccagcrgacrtccctgagcacttccggggcagggtcagcatctgggccatrrtgaccagtgtggacgggagccagcaggtcrcgttcgatgactccacccccgtgcagaggcagctggtggacatccggtactccaaggacacgaggaagcagttcaagccgggcctggcctacgtggggaaggtaacttgggrgtgactgtgctgcctcccgcccaaggaccaccgtgaaaccaccaccactagccactagctctgcagtggtgactcagctgaaaaygratcccctgacataacctttgcggagagtggagagggctggtgttccaggtgaggggcaggggacattttcctccacgggaaaggacaatctactctattccacttggacagacatctgagtagccatttattaaagcaactgctctaaggcagtcctgtttcttcaatgggttcttttttttttttttttttttagagatagtcacactccatcgcccaggctggagtgcagtggctccatctcggctcactgcaacctccgtctcccaggttcaagtgattctcctgcctcagcctcccaagtagctgggattacaggaacatactaccaagcccagttaatttttgtatttttagtagagacggggtttcgccatgttggccaggctggtctcgaactcctggcctcaagtgaacttcccgccttggcctcccaaagtgctggggttacaggcgtgagccatcactcctggcccttcactgggttgattttatcccctgaggacctaagttgagagccctgcaaaggtagaccttctgttcctgagactgacaggtgcagacccatgtgacattttgaacgagcctctgcctcccacccaccactcaagtcttatgcacggtaaattttgaggtgtccagatgtcatgatccttatatatgttttcttcttagagacagggttttgttctgtcgcccaggctggagtgcagtggtgagatcatagctcaccacagcctcgacatcctggattcaagcaatccgcctgcctcagcatcctgggtagctgggactgcaggcatgagccaccacgcccagcaaatttttttatttttaaatttttatttatttatttattttgagacaagagtctcgctctgtcgcccaggctggagtgcagtggcatgatctcgactaattgcaacctctgcctcctgggttcaagtgattctcctgcctcagcctccagagtagctgggattacaggcatgccccaccataccccactaatttttgtatttttagtagagacggggtttcaccacattggccaggctggtcttgaacacctgacctcaggtgatccacctgcctcagcctcccagagtgctgagattgcaaacaggagccaccgcacctagtcaattttttaattttttgtagagatgggatcttgctgtgttggccagactggtcttgaactcctgggctcaagcagatctcctacctcagacccccaargtgctgggattgcagatgtgagccactacacccagtcattattcttattttaactgttaaactggggtaggctgggcacggtggctcatgactataatcccagcactttgggaggcccaggtgggcggatgacctgaggtcaggacttcaagaccaacctggccaacatggtgaaatactgtctctactgaaaatacaaaaattagccagacatgatggtggacacctgtaatgccagtgactcaggaggctgaggcacgataattgcttgaacctggaggcggaggttgcagtgagccaagatcacaccactgcactccagcctgggagacagagacttcgtctcaaataaaaaaacaaaaaacaaaaaacaaaaacaaacctggggcatcttcaccccaattgcagcagcaggagtggggcaaggccaacagagcccagtgtcatgcaaggggaaagtgggccacatccctggccctgcatctgtctgcacccagttcccttttgccgtccatgagtgatgctggctggctgtcctaacactgagttctgaccctcttgttctgctttggaacctcctttctcttctccatgccagtgttggagccacctctatcccatgcacagacacatctcctgtgtccctggctttgagggccccagcttgagtagaaactaaagtacctcgtgcggggtcagaatgtgtatgaagaagaggtttaaggctacaaatttggtaaagagcgtttcacatatgacagaaaatacctaccatctgcattcaagaaaggagtggttaggctgggcatggtggctcatgcctgtagtcccagtgctttgggaggccgaggcaagaggaccacttgaggccaaggcaagaggaccacttgaggccaaaagtgtgagaccagcctgggcaacatagtgagatccagtctctacaaaaaataaaaagaaataggccagacgtttgtggctcacactttgggagaccaaggtgggaggattgcttgagactgggagtttgagaccagcctgggcaatagagcaagaccccagctctacagattttttttaaaattagccaggcatggtattgtacacctgtggtcccagctatcaggaggatgaggcaggaggattgcgagcccaggaggtagaggcagcagtgagctatgatcgggccacttcactccagcctgggcaacagagcaagactctgtctctcaaaaaaaaaaaaaaaaaaaaaaaagggagtggttaatgaagatcatgtgggctgaatcctggttcactccgtcaccagatacctgcacagctgagggctgttttagggttcttcagaggctacaatctgtgctccttttaaaacatctatgtctscctcattctagctggctctccaaccagtctgaatgggtgaggtttaagtgtcacactgaactgtccataccctggtatggcatcagactaatgactagcacatgtaatttgtacttcatgacctctttgccaaatccragggcatgaaggtctacccttatgtttcttctaagaatgttatagctttagctgttacatttaggtctgtgatccatttgagtttatttttgtatatggtgtgaggtagggatgcaacttcatttaaaactttttttctcttaagagacagggtctcattcagtcactcaggctggagtgcagtggcaccatcatagctctctgcagccttgaagtcccagactcaagtgatcctcccacctcagcctcctgaatagttggggctataggtgcatgccaccacacctgaaattttaaagttttttgtagtgaggtctcactatgttacccaggctggtctggaactcctggcctcacatgggattataggtgtgagccactgcatccggcttccatgtctgccttggaagcctcttgagtagctgggaccacaggcacacgccaccactcctggacctgtgagtccttcttttttgttccctttaaggattgtttttgcgatttggaactcgttgcgatgccctgtgaatttcaggagcagtttgtcaatttctacaaagaagcctgctgggattccagtggggattgcgttgattctgcagatcagtttggggagcatggccgtcttaactctgttgtgtcttgggtgaccttttctaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggaggtgggtgagtcccgtggacccttgttattcagccagcaggtatggacttggggcctcccccagrctgggtgcaggcacctgatcagtgggcctggagcccgtcccagccctgcaggagtacacattccactagacagtgggatggacaacacagccatcctgggatcaggtggaaggtcaaagagagataagggtgcctggaccagttatgccaaaggagtcttgtccaaggagatctctccaaatggactcctgaccatggggaagtcagccaggctgcttctgggcgggtggaacagcctgggtgcaggttcagaggcagaccgtgattatactgtaatcagagtctcacaagtgctcaactacattgagccattttggaaagagattggggagagagccaatggtggtttccgccacctcacgggtgctcagtggaaggcagtgtcaggcgaaagagtgatctgatttttttttttttttaagagacagggtctcgctctgttgcccaggctgcagtgcagtggcatcatcatagctcactgcagcctctaactgctgggctaaagggatcctcctgagtcagcctcccaagtacctgagattacacgtgcatgcccgtaattagcacctcacccagctaatttttaaatttttctgtagaggctgggcacagtggctcatgcttgtaatcccagcacgttgggaggccaaggcagatggatcacctgaggtcaggagtttgagaccagcctggccaacatggcaaaaccccatctctactaaaaatacaaaaattagccaggtgttgtggcaggtgcctgtaatctcagccactctggagactgaggcaggagaattgcttgaacccgggaggtggaagtcgcagcgagccaagattgcgccactgcaccccagcctaggcaacagagtgagactccatctcaaaaacaaacaaacaagcaaataaataaataataaatttttctgtagagatggggtcttgctatgttgcccaggctggtctcaaactcctggactcaagccatccttccacctcagcctcccaaagcatagggattataggccatgagctgccatgtctggcctgatctgattttcgatacccagtgatcactccagagtctttagttgggggtggttcagggcgggcccaggcaggcagacaggaggtgaggacagagaggtctccaaactggagctcttgaggaagtagatccagaaggccttagtgtcccatcatcaggggaggcaagaacaggaggkactggagaggatgtcccagcccttggctttgggaactggcagtggacctggcggccctgcagagagtaaatacgtagatgggaactgaggacactgtggtcactttgtcctctgtgggcaccatgtcctaaaggttttaaccactgaagccactgccttgccactygacattcacagccagatgggttcacgctttcttgtgttggacctgctgctcaacacacagcacagctgtttggtcacctgggccactgttctgttgttttttttttttgatacagagtcttgctctgtcgcccaagctggagtgcagtggtgcaatcttggctcactgcaacctcggcctcccaggttcaagcgattatcctgcctcagcctcccgagtagctgggattacaggcgccccccaccacgcccagctaatttttgtatttctagtagagatggggtttcactatattggtcaagctggtcttgaactcctgacctcaggcaatccacctgcctcggcctcccaaagtgccaggattacaggtgtgagccaccgtacccggcccactgtcctgttttaagagagtgaccacagcctggcatctctcagactccttgaggaaccagagatctgccctgcccatcccctaccaggtgggagattgcagtaacttctgacaccagctacctggagctgggccacacttcacaggtggtaggcacagccctctccacaagactaccctaaattctgacaccagctgcaagtccaggggtccccgggccacctgtgcttcccacctactggctgcaaattccactaccctaccaccttttaattacagctttaccatagcaaaatgacataaattagaaccaaccaaagagagagatgcatagggtgaggtctgggcaattcccagattggaagctttgtgtgttctctgcacagaaccaggatatgtaatccccacaagctgagcattgctaagcaggaaagctcacctgagctttggtgtccaaagttttttgtgggggcctcatttcgtctgcatgattgattaaatcattggccatgggactaatctcaatctcctgccctctcccttccctggagatgggctgataacctgtggctcaaagcccagccatctaatcacacaactggcctttctggtgtggcccgtttataccctatttagagtctacctacttcccaggagccagagacagaggcaggccaactttttttttttttttttttttttttttttgagacagagttttgctcttattgcccaggctggaatgcaatggcgtgattccagctcactgcaacctctgcctcccaggttcaagtgattcccctgcctcagcctcccaagtagctgggactacagttgccggccaccatgcccggctaattttttgtattttagtagagacagggtttcaccatgttggccaggatggtctcgatctcctgacctcgtgatctgcccaccttggcctcccaaagtggtgggattacaggcgtgagccatcgcgcctggcccaacttctttttaaaattatttcagagatacggtctagctctgttgtccaggctggagtgcaatggtgtgatcatagctaaattgcagctttgaactcctggactcaagtgatcctcctgcttcagcctcccctagtagctgagtctccaggcacaaattttttgtagagactggatcttgctatattgcccaggctggtcttgaactcctgggcccaagtgatcctcacacctctgcctcccaaaatgctgagattataggtatgcacccactctgcctgacccccaataccctttgaccaatcttggatgcttgcttcttttttttttgagtcagagtcttgctctgttgccagcctggagtgcagtggtatgatctcagctcactgcagcctctgcctcctgggttcaagcaattcttgtgcctcagcctcctgagtagctgggattacaggcatgcgccactactcctggctaatttttgtattttttcagtagagacggggtttctccatgttggccaggctggtctcgaactcctggcctcaggtgatccacctgcctcggcctcccgaagtgctgtgattacaggtgtgagtcactgtgcccagctggacacttgcttcttgatgctaggaagaatgggctggacaactggctaytactccctgaggattggggagggggttccccaaagggatattggagcatgagagggtgtttcttctgggcagagcaagcagaagcatccccaagaccccctttctgctcttggcactcgggtgttgatcyaagcatcttctcttctcagaccaaggtgatggcactgaacgggaagccygwgggggctcagtacctgcccagctacctctccctcggcagctggtactcccccagccagtgctacctgcagctgcagccaccctcccacccactgcaggtaagattttcaggwgctacccttcctgggccatgcgggatccaaaaagcagcatgagccaggtgctgtggctcatgcctgtaatcccagcattttgggaggccgaggcaggcggatcactggaggttaggatttcgagaccagcctggccagcatggtgaaaccccatctctactaaaaatacaaaaattagctgagtgtggtggtgcgtgcctgtaatcccagctactcgggaggctgaggcaggagaattgcttgaacccgggaggcagaggttgcagtgagctgagatcacaccactgcactccagcctgggcgacaaagccagactcctcaaaaaagacacagcatgagtgagcccctaaggcagcagtagccagcctttttggcaccaaggattggttttgtggaagacaatttttccacagacgggggcacgggcacgggggatggtttcaggatgattcaaggayattatgtttattttgcacttcatttctattattatgacattgcaatatataatgaaacaatgatacaactcaccatcatgtagaatcagtgggagccctgagcttgttttcctgcaactagacagtcccgtctgggggtggtgggagacagtgacagatcatcaggcatgagattctcattaggggcatgcaacctagatcccgtgcaagcacagttcacaatagggttcacactcctgagagaatctaatgctgccactgctgatgtgacaggaggtggagctcacatggtaatatgagtgatgcgagcrgctgtaaatacagatgaagttttgattgtcrgcctactactcacctcctgctgtgtgacctggttcctaacaggccatgaatcagtactggtccatggccctgggggttggggacccctgctctaagggacctaatactacagctgacacagggatcccttatctccccagcaaggggagaattctgcagaatgcatgcatgcattactatttgtttcttttctttctttttttttttgttttgtttttgaggtggagtctcactctgtcagccaggctggagtgcagtggcacgatctcagctcactgcaacttccgtctccagggttcaagtgattctcctgcctcagcctctggagtagctgggattacaggtgcccaccacaatgcctggctaatctttgtattctagtagagacggggtttcaccatgttggccaggctggtcttgaacttctgacctcaagtgatctgcccaccttggcctcccaaaatgctgggattacaggcgtgagccaccacgcccggctcgttgctatttatttgttatggacatttaggctgtggcccagggctgacaatgatgatcaccactctgccccagggcaccactgcacccagacctgacatagagctgctgctatggggccagattccccactgccttgagccttcccttagtgcagaggccctgggagtttctccacacagacactctgagtgcaaagacaaggtaaatttagagccgtgtctgccattcatttttcctgggtctattattttgcaattctgattacataaggtgtgtgtgtgtatttttcttttaattaatagacttaattttttaagagcagttgtaactttataaaaaccttgaacaaaaagtagagttcccgaccgggcgtggtggctcacacctgtaaccttggcactttgggaggctgaggcgggaggattgcttgagcccaggagtttgagaccagcctgggcaacatggtgaaatcacatctctatcaaaacaaaaacaaaaacaaaaaaaccccagccggatgtggtggtgcatgcctgtagtcccaattactcaagaggctgaggcaggaggatcacttgagcccgggagattgggaccgcagtgaaacatgatcgtgccactgtactccagcctgggtgacagagcgagaccctgtctcaaaactaaacttaactaaactttatctatagcttactattggccagagtcaatcaacacagattttgtactttctatgcatgatatactgtattcttacaataatgtaagctacaggaaggaaaatattattaagaaaatcataagattttcttaygctggcaggcgcaggtaaaaaaaatcataaagaagagaaaatatcttgactgttcgtgaagtgggaatggatcattgtaaaggtcttcttccttgtcatcttcacgttcagtaggctgaggaggaggaggaagaggagagggggtcctgctgtcttgcttgggcagaggtggaagaaaatccacacatcagtgttgtgggcagttcaaacctgtatttctcaagggtcaactgtatatatgtgcatatatatggatatgctgtgtacatgtgtgttcatagacatctagatacccacatatacatatatatatatatatatatatatatatwtwtwtwtttttttttttttttttttgacagagtctctgtctcccaggctggagtgcagtggcacaatctcggctcactgcaacctccatctcctgggttcaagcamttctcctgcctcagcctcccgagtagctgggattacaggcacctgccaccatgcctggctaattatttttgtatttttagtagagacagggtttcaccatgttgaccagggtggtctcgaactcctggcctcaggtgatccaccctcttcggcctcccaaagtgttgggattacaggcgtgagccaccgcgcctggccatacacatctatatttaagatacatcacccctctgttaactttgtggactggtggcaggctcactggctgggctgtttgcatcctggccgcaatcccagcagagcctctggctcaagctatagccccagccttggcagaaatgtcacccctaatggaaaccagttgccatcacagcgcccagggccctaccagcccataaacctctcacactccttttctgatcatatcgaggcccctggggttcagcttggaggaatcgtggcgccaaggctgcctgtttcctgggattaacagccctttgcagaggttgtaagaatgagaagtcagacaggatcatgcccagcttggctgaacacactgttcttcttgtaattccattaaaccagtggtgcagggtggggacgctggtgctggcctcctcctcaggggacaggaaggaaccttgtgttctcagctggccagactgttgttctgattagggggagacctggctctgtcactcagattttgctccccgggtgaatctcaatcctgtttgaggtggctcagaaaccccagcgcgtcctacccaccaaactgccatgaggggcccgggcacaacctcagggcatggagggaagatgggttcatgctggggccaggctgggcatggtgcagggacctcttcctcttcttctagcgccagggccccggcaggggggaactggggggctccactccccacatcttggcacccatccttctgaacctgttttgcttggtgaatgggggcgctcactccaatcttttaaggttgttttgatgccataaatttagtaaagaagaggagaaaggtttgtgctctccttttccccccaagatctcaagcagaaggggacttctgtttgggtgtctttttataagggggacattaataaatttagagtgaaattgaaaaatgttaatataataaacaaccatgagactttcacctagatttataaattaatgctttgcctatatcctttcattcatccctccatccaccctccatctctctstccatccctccatctgtccctctcttcatccctccatccatctatcctctctccctccattcattcacccttcctccctccctccacccatccatccacctactaccctttatccactcatcttccctccatccatccacccttcatccatccatccatcctccatctatctattcatccatccatccaccctccctctgcgcctcccttcatccatccatcatccatccatccatttactctccctccctcctttcttccttcccttccttcctttctccacccatctatccacccactacccctatccatttatcatccatccatccatccttccgtctgcccttcatccacccttcatccatccatccatccatccatctaccctctctccctccttcttttcctcctttctttctttcctccacccatccatccacccactacacttacctatttatctaccctccatccatccatccatccatccgcccttcatccattcatccacccttcatccatccatccatacatgcacccttcatccatccattcatccactctcccttcatccattctccctctatccctcccttcatccatccatccatctgccaattcacgcatccatctatttctctacacattttttggctgcagcatttgaaagcaagttacaaacatgatagtgcttcactcttaaatacttgaccataatgtatacttaaaaaaaggcattattttacctgacctcaaggccattttcttaggtcacacctaagaaaattacattcaccaaattatattgtctaattcataggcaatattcagattttcaatgggtaccctaaaaatgtaatttacatttagtgtttgtttgcatgcatatgtgactgcatgattgtatcacacatgtgtgactacacatgagtgtgcatgtgcatttgtgtgagtgtgtgtgcatgctcacccatgtgtatgtacttggtttttaggggtttcactatgttgcccaggctggtcttgaactcctggcctcaagtgatcctctctgcctcagcctcccaaggtgttgagatgacagatgtaaccaccacacccagccccactactgttaataattgggttgtttatctttgttgagtcgtgaaagttctttctaaattctggatactagccctcatcagatgtgtaatttgcagacattttctcctatactatgggttatcttttcactttcctgacagtgtccattagtgcaacaaaaaattttaattttgatgaaatccaatttctctttttcttttgctgcttgtacttccgatgccacatctcaaagaaaccattgccaaatctaaggtcatgatttatctctgtgttttcttttaagagttttatagtttcagctcttacatttaggtctttcatctgttttgagttaatttttttatatggtgtgaggtagggatccaaattcattctctctctctctctctctctcttttttttttttttttttgagataggaccttgctctgtcacccaggctgaggtgcagtagtgtgatcatagctcactgcagctcaacctcctgggctcaagtgatcctcccacctcagcttcctaaagtgttgagattgcaggtgtgagccaccacccacagaccaacttcactcttttgcatgtacctattcagttgtctcagcactgtttgttaaaaagactatgctttccccattgaatggtcttggcacccttatttcaaatcagttgcccttagctgtctggattcatttcagggctctcacttctatcccaytggtttctatgtctctccttatgctggtactacactgtcttgattactgtagctttgtagtaagttttgaaattaggaagtgtgagtcctccaaygttattcttctttttcaagattcctgagtcctttgtgttttcatataaattttaagatcagttccatttctgcaaaaaaggccattgagattttgataggcttcccctaatgctaacatcttacaagactatgatccatttgtcataactaagaatcaacactggacatcagtgttaaccagactccagattttatttggatttccccaagttatcccactcatggccttgttttctggtccgggatcacctttagggtcccacgtcacatttagtcatcacgtctccttggtctcctccaatctgaaaattttattctttccttgtctttcacgaccttgacattcttctttttcctttctttgtttttaattaatttatttttgagacagggtcttgctctgtcactcagtatattagtccgttttcatgctgctgataaagacatacccacgactgggtaatttataaagaaaaataggtttattgttatttatttatttatttatttatttattttgagatggagtctcactctgtcacccaggctggagtgcaatggcacaatctcagctcactggaacctctgcctctcaggttcaagcaattttgctgcctcagcctcctgggctgggattacaagcacctgccaccgtgccttgctaatttttgtatttttgtagagatgggctttccccatgttggggaggctggtgttgaactcctgaccttaggtgatccgcttgccttggcctcccaaagtactgggattacagacgtgagccaccatgcccagccagaaaaagaggtttaatggattcacagttccacgtggctggggaggccttacaatcatggcagaaggtgaaaggtacatcttacatggtggcagacaagagagaatgggaaccaagtgaaaaggraaaccccttataaaattatcagatctcacgagactcattctctaccatgagaactgtattggggaaactgtccccatgattcagttatctcccactgggtccctcccagaacacatgggaattatgggagctacaattcaagatgagatttgagtggggacacagccaaaccatagcacccgaggctggagggtggtggcacagtcatggcttactgcarccttgacctcctgtgctcaagtgatcctcctgcctcagcccccctagatagctgggactatgggcttgtgccaccacacccagctattttttttattattttttgtggagatggagttttgccatgttgttcaggctggtcttgaactcctgaactcaagcaatctgcctgcctcagcctcccaaagtgttaggattataggcatgagccaccacactcagctgacattcttctttttgctgctcaaattttccaaatttggctgtgggagtcccttaggcccagcttcttaaacaggcagattcttcctttagggggaggtagaatgacatttatttttcttactatatatttttttaattaaaaaatattgattgattgattgagacagggtctcactctgttgcccaggctagggtgcagtggcatgatcatgactcaccgcacatcgacctccctggctcaagtgatccttccgccttagcttcccgagtagctgagaccacaggcacccaccaccacatccacctaatttttgtatttttgtagagatggggtttcaccatgttgctgtggcgggtcttgaactcctagactcaagcaatcctctcgcctcggcctctcaatgtgctgagattacaaagcatgagccactgcgcctggccaaagttttttgattttttgtagagacgggatctcactttgttgcccaggctggtctcaagcttctgggctcaagtgatccacccacctcagcctaacaaaatactgggattacaggtgtgagccatggcccctggccagaatgacacttattagccacctacagtgtgcattgtgtgatgttgagcatgacacacacatcatctcattggagcctcaggaccctctgtccaggagataacagccttattttacaggtggggaaactgaggctcagagaggtgaaatgatttgcccaagcttccacggcaagaatgtcactcttcccctactccagatatccctcttctgggctttcagggtgatcccaacatttggggacagtcacagattgcaaaacatggaacagaggcgggattcctagggcaaagtgttggacatggccacacgccaaccccctagggagatcttaggacctgggaggccttagctttcctgatatcagaataatggcagcttcagggttcaatgtggggccttagcatcagttcccctgagtttgaatcctgccctacactcattgacattgggcaaagaaccaaggcctcagtttccagttttcccctctaggaacttggggactatgataggacccaactcattgagttcatatcctaagagaaggcccagcccacttgtggcattagcacgttcaaagttaggaaacartattttatttttatttttttttggagacagggtctcactctgttacccaggctggagtgcagtggtgcgatcatggctcactgcagccttgacttcctaggctcaagtgaccctcccacttcagccccctgagtagcggggactacaggcatgtgccaccacgcctggccaattttatgtgtgtgtgctttttgtagagatgggggtctcactatgttgctcaggctgctctctaacttctggacttgagcgatctgtccgcttcagccccccaaagtgctgggattacaggcgtgagcccaaaatactgggatcacgaggtcaggagttcgagaccagcctggccaacatggtgaaactccgtttctactaaaaatacaaaaattataccggcatggtggcgggcgcctgtaatagctacccaggaggctgaggcaggagaatcacttgaacccaggaggcagaggttgcagcgagctgagatctcaccatcgcatgccagcctgggtgacaagagtgaaacactatcttaaaaaagaaaacaaaaaacaaaaaagctaggggccaggactggatgctgggcactccgctccctcagccatcccaacctccctctggccccagaatggccgtcttcctgtggtgggttgcaacattggtrcgaggcagagccccccatgctgcgtgtcttccataggttggggaagaagcctatttttctgtgaagtccacatgtccctgcaactttaccctgtactacgaggtggctgcacggggcaatattgtgctatcgggccagcagcctgcccacaycacccagcagcgmagcaagcgggcrgcccctgccctggagaaaccgattcgtttaacacacctttctgagacaggtgagccgggcagcagggagaaggttcctgttcttccttctgaacaattgagactgagatgggtgctcctgcaaggagggacaaggcaagacccagcagagaggggagcatgccttgggtcagaggggayacatccttaacrataccagactgggtccaggaagamagtgatcagctrctggaagtggagaggttcaggccccagactcttctcactctgtgtgtgcaggggacagggaaagccagccacagactaggctcttgcactggcccacattgtgctgttgcctctttgcccaggyggttctgcctatgagtcctcttcctcttctctttttgacaccatgtgctcctcataaggccctcctcccaggggacttccttagtcccctcctcttcaaagctcttcttctcaatacagggtccccaacttgagcactatagacatatataagggggtggatcactccagagtgggggcgtcctgtgcactgtagggtgctgagcagcatccctggtctctccccaccagatgccagtagtaccaactttccacagtatgatgacctaaagagtctccagatattgccactatccccagggggcagagtcacttccaggtgaggacactgagataggtaggtagatagayagaatgatgggtggatagatagatvggcaggatctctcaggckaaggcaaggtttctcaaccttggcactatcaacatttgggcaagatcattctctgtggtggaggcactgtaggatattgagcagcatccctggcctccaccccatagatgccaatagccctatagatgatagagggatggatcaatggatggatggacagatagaaagatggatgaatggatggatggatggatggactgatagaacagtggatagatggaaggatggatggatggatggataggtggatagatggatgaatggacagagagatggatggatggatggatggaccaaaagatggatggacagaaggatggatggatggatgaatggacagatggatgggtggattgatagatggatggatggatggatggaccaaaagatggatggatggatggatggatggatgaatggacagatggatggatggacagatggatggatgaatggacagatggatggctggatgaatagatggatggatgaatagatggatggaggtacagaaggatggatggatggatggctaatgggtgggtggatgaggattagatgaatagatggatggatggatggatagtgggtgggcggatgatgactggatgaatagatgaatggatggatggatagtgggtggatgggtggatgatggatggatgaatagatggatggttggatggatagatggatggatagtgggtggatgaatgggggatgatggatggaagaatagatggatggatagtggggtgggtggatgagtggatgatggatggatgaacagatggatggatgaacagatggatagatgattggatggtggatggrtgggtggatgatggatggataaatggatggatggtgggtgggtggatgatggatgatgaatagagggatgggtggatggttggatgggtggatgatggatggttgatgaatagagggaagggtggatggtgggtgagtggatggatgggtagatggtggatggatgaagagatggatggatggatagatagaaagatgagtggatagatggatggatggatagatagacagacagagaagatccctccttcttaggcaggctttctcaccctctgcactgtcaacatttgggaccatcccatgcactgtaggatgctgaatagcatctctggcttctattcaccggaagccagtagcatcccctccagcagtgatgaccaaaaaacatccgcagayattgcyagcatcccctgggtagcagaattgccttggctgagaactgctggccagagtcctgctttgggcatggtgcaccttcaccctcttggtcttctcttctcttctgggtgaaataacagggactttatgtctccctggaatccttgtccagggccagccctgggcttggaactccccacaatctgtccccatttaaccccactgcagcctgggatggtggtggttccactgtgtccatctgcagatgaatgggctgtgacttgggggtgggggtttcagggactttcccattgcctagtaggggccagagccargatttgaaccccaaggccgattgggtacccacttcctcctgttgsccatgagtttccttgtgtccccgctttcccctaccatccctgtccactggctgctctgagctctgcacagaaccagctgacagatggcccattctggaactgggagcctttctaccctcattctcttgccgtagagtatttgggagtgcctggacaggcttctaagatcctctatcctttaaggatcatttacccacagggaaggcagtatgaactcggttcaagtcagcaaataatggctgcccaggtctgctggccccaggccccagcaagacagagccaatcagagggagggactggaggtcaggggcatattggggagctgcagtggtgctgcctggacaagccaaggtggttttggtgtccgcggaggaagcagagggctggtcagggagcagggaccatgttccccggcagagaggatgattctaggcaaattccagcctgctctgtaggagcccatggtgaccctagagctgagtcaatagaaagagtcagcattgactgaggatgtagcctgggaagggcatctcaaaaccaaagatgcagactgtctcaatgygtagacaggagcatagcgcagggcaaattggggcagagcctgaatggctgaggttgcatgtcggatgcggagaattcaccacctctctctacttttgctcacctcagagcccccaccagccccagaagctgaggtcgamgtgtgtgtgacctctcttcrtctggccgtgacccccagcatggtcccccttggtcgcctgctggtcttctacgtcagggagaatggagaaggggtcgccgacagccttcagtttgcagtcgagaccttcttcgaaaaccaggtagagcatcgtgcactgaacctgggacacagccaggggccatcggggcttctccarggtgctggccagggggtctgtgcacacctgagactcatgttgtgtcgcagcatgatgtaaggaattatgggaacatgagttgcatctttactgaagcatctccaaargtcacacaaaaggagattgcattcaaaacacatrgggaaagccatcaattattctctgcstttgttgaattcaggatttaagggacagcacttgtttccatyggcaccctcagcctcctctccccctccctgcaacaactttattattattattattattttgagacggagtcaagctctgtcacccaggctggagtgcagtggcaygatctcggctcactgcarcctctgcctcccgggttcaagcaattctccggcctcagcctcccgagtagctgagactacaggcatgtgccaccatgtctggctaatttttgtatttttagtagagatggggtttcacyatgttggccaggctggtcttgaactcctggcctcaagtgatccacatgcttcagcctcccgaagtgctgggattacaggtgtgagccactgcgcctggctcctccctgcaacttgtaaacaaactgccacaggctctccgccagcacctgccttcccatctctgcctgtccctctgtgttcccttctttgtgcccgctgcacaatgaccagctgcccttcacagtgtgggaccagtttcacccaggtagcgaggccaggttcccagctgagctggcaaagacccactctccttggtgggcagggggtgcatgggtggggcagaagagatgcctctggactagaccaaacctggattgaaccaagtttctttttttcattgtttgaaatggartttcattcttgttkccctggctggggtgcaaccacactctctcagctccctgcaacctctgtctctgggcttcaagcgattctcctgcctcagcctcctaagtagctgggattacaggcacctgccaccatgcccagctaaattttgtatttttagtagagatggggtttcaccatgttggccargmtggtctcgaactcttgacctcaggtgatccacccrcctcggcctcccaaagtgttgggattacaggcgtgagccaccactcacagccaactgaaccaagtttcttatcccttgctgcatttgcgccaaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggtgagcagacccctcgggcttgggttctagacctccacrgggctttaccttctcttgctctccctttcccatctctcattccaataaatgaagagtggcatttgaatccagattcgctttctccgtcgggttcatttttcagggaacctaatgggtgtctgataaatccttcctgctgcttcagcacagttgcaagatcagggagtcaaggtcatcagatttttgcaacatgacattgggccaggtctcacctctctggctccaatttgcccatcttattttatattatttttagagttgggatgttgctctgttgcctgggctggagtgcagtggcgtgatcatagctcactgtagcgaacacctcctgggcttaaacgatcctcccacctcagcctccagagtagctggggctacaggcatgcaccaccacgcctggctaattttttctatcttttgtaggggyggggtcttgctatgttgcccaggctggtctcraactcctttgcacaagccagcctccwgtttcagcctccccagtaactgggattagaggcatgggccactgtgcctggctcctgtttgcccatcttaaaatgggctgatgctaccagtgcccatctcctggaggttgtcatgacgtgataaagaggttgggatgggagcatgccacacccacgggagccagtttgggttgtaaagaaaacttcagctgacaagtctctgtccccctttgcctgcaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgtaaggagaggtggtctcagatccctctgcccccttctaagktcctcttgcctagaaataagagtcttggagattcagaaatgggttggaaacagaattggaagcttttctttctttttttcgagatggggtctcgctctgtggcccaggctggagtgcagtggtgtgatcatagctcactgcagcctcaaacacctgtgctcaagtgatcctcccacctcagtctcccaagtagctggcactacaggtgcatgccaccacacctggctaattttattttgctttatttctttgtagagatggggtcttgctacgtggccctggctagtgtcaaactcctggcctcaagcaatcctcctgcttcaacttcccaaagtgttaggattacaagcatgagccattgcacccagccttccaaacttttctttttcatttctccccagtgaaagctcacaagtagattcttccaatttgcaaagccgtggagagcagaatgttatgcatgtcaatggtcaggttcaaatgggtaacttgaacttgtgatgggacgtgttatgacattgacrtgctttgctgcgaggaaaaccttctcattgggagctgtgggtgccagtagctcttagctctgcctcggctttggttaacttggttgtgtgtctggcagctttcaagcagaaggaggtggctgtgatcccaggtggcagggggtctgaactgcataggtgatcctcgtgccccagcctccctagtcgctgggattagaggcatgagccactgtgcccagctccagtttacccatcttaaaaagggctaakggggcgcctgtagtcccagctactcgggaggctgaggcaggagaatggcgtgaacctgggaggcggagcttgcagtgagccaagattgcgccactgcactccagcctgggcgacagagcgagactccgtctcaaaaaaaaaaagggctaatgctggctgagcgcggtggctcatgcctgtaatcccagcactttgggaggctgaggtgggcggatcacaaggtcaagagatcgagaccatcctggccaacacggtgaaaccccctctctactaaaaacacaataattagctgggcgtggtggtgcatgcctgtagtcccagctacttgggaggctgagtcaggagaatcacttgagcccgggaggtggaggttgcagtgagcagagatcacatcacttcactccagcctggtgacagagccagactccgtctcaaaaaaaaaaaaaaaaaaaaagggctaatgctatcaggtgcccatctctggacgttttcatgatgtgatatagatagaaagggattgggatgggagcatgcttcgcccttcagggtcacaccttagggtgctggtggtctccactcaaatgcgtgtcccattggagggtgcctttcatttcagctttaaaaaatatttctggccaggtgtggtgtctcacgcctgtaatcccagcactttgggaggccaagacacgtggatcacctgaagtcaggagttcgagaccagcctggccaacatggtgaaaccccgtctctactaaaaatacaaaaattatctgggtgtggtggtgggcgcctgtaatcccagctactcgggaggctaaggcaggagaagctctggaactgggaggcggaggttacagtgatcacgccactgcactccagcctgggtggtagagcgagactctgtctcaaaaaaatgaaattaaataaataaataaaatttcaaaggcatccttccctccccaacctgtgttgcttttatgatgaaaatttccaaacatgcagaaaagttgagcgaattagacaaatacccacatgcctgccacctagttcccacagttctatttgctaaaaacaaaacaaacaaacaaaaaaatctcttatttttctttttttgagacaagatctcactttgtcacccaggctggtatgcagtggcgtgatctcagctcacttcagtctcgacctcctgggctcaagcgatcctcctgcctcagcctcctgagtagctgggaccacagacacacgccatcatgcctcgctaatttttttcgtatttatagagatggggtttcaccatgtcacccaggctagtcttgaactcctgggcttaatggatccacccgcgttagcctcccgaagtgctgggattacagacatacaccactgtacctggcaaaataaacctttgtgttttgttttttgttttgaaaaataacatttcatttatgagtatgtgaactgcctggcagtttgaactccaggtcccttctggaagtcagaggtgacgcctttgagtcaaaggaactgggtttgaatttcttattcaaaggctgggcgcggtggctcacgcctgtaatcccagcactttgggaggctgagacgggcggatcacgaggtcaggagatcgagaccatcttggctaacacagtgaaaccccgtctctactaaaaatacaaaaaattagccgggcgtggtggcgggcgccagtagtcccagctactcaggagaatgaggcaggagagaatggcatgaacctgggaggcggagcttacagtgagccgagatcgcgccactgcactccagcctgggcgacagagtgagactccgtctaaaaaaaaaaaattcttgttcacaaatccaagtcagcccaggctacagtgagtcttctttcaaatccagttgctcccagtaattagtacaatgatgaggacagaataaaaagactaattgcatagccgggcatggtggtgcactcctctagtcccagctactcaagaggctgaggtgggaggatcacttgagcctgggagtttgaggctgcagtgagctatgattgcagcactgcaccccagcctgaaccacagatggaggccgtctctaataatactaatactaataaaagagatcattgcatcccaccgttggtccttggttggggtcaggtactgcgccaactgatttcctcccctgctctcccctcacttccccttccttcttttcttttctttttcttttgagatggagtcttgctctattgcccaggctggagtgcagtggtgtgatcttggctcactgcaacctccgcctcctgggttccagtgattctcctgcctcagcctcccaagtagctgggattacaggtgcccaccaccatgcctggctaattcttgtatttttagtagagatggggtttcaccgtgttggccaggctggtgttgaactcctgatctcaagtgatccgcccacctcggcctcccaaaatgctgggattacaggcatgtgccactatgcctggccatgatttttctaatcgagatgaaattcatataacataaaactcaccgtttaaaattcagtggcatttattatattcacagtgctgtgcaaccaccacccctacttaattccagaccattttcatcccccaaaaggaaaccccatccccagtagcaattactccccatttcccctccctcagcccctggcagtcaccagttgatctgctttctgtctctatggatttgcctgttctgggcgtttcatctcaacggaatcatacaacatatggccttttgtgtttggaccatctgatttggttgcacagttcaaatgtgctgttctctcttctccaccctggatggtcactgggtcccacgttctccccagcctgtgccaccaaacccagagtaaaagaatgatgccccatggtgacgggcacctgtagtcccagctactagggaggctgaggcaggagataggcgtgaacctgggaggtggagcttccagtgagccaagattgcgccactgcactccagcctgggcgacagagcgagactccgtctcaaaaaacaacaaacaaacaaaacaaaacaaaacaaacccaaaaaagcaaaaaaagaatgatgcccccaaggttgccacaagctgatattgggacagtggccacagggtgattcattcccttatgcttctgggggctgtcagcatccacttccccaccaatggtttgggtgttgtctgttgcctaggaaacgggactggtggtgatgaccgamcgagtgagcctgaaccaccggcaggacggtggcctctacaccgatgaggctgtccccgctttccagccccacacagggagcctggtggcagtggctccttccaggcaccmccccaggtaacggcttatacattgagcaaggttttctaaccctggtcctattaacatctggggcttgtctttgtccttcctggctgctataacagaagaccatagaccgagtggcttataaacaactgaaatttatttcacatggttcttggggcttggaagtccaagaacagggcaccagctgattgggtgtctggtgagggctcacttcctgcttcattgatggtgccctctggcttcttgctgtatcctcatatggcagaaggagtgagggagctctctggagcctttttttttttgagatggagtctcactcaatctgtcccccaggctgtgtgaccacacccccagtggtgtgatcttggctccctgcaacctccacctcccaggttcaagtgattctcctgcctcagcctcctgagtagctgggattacaggcatgccaccatgcctgtctaattttcgtatttttagtagagacagggtttcaccatgttggccaggctggtcatgaactcctggcctcaagtgatttgcctgccgcagcctctcaaagtgctgggattacaggtgtgagtcactgtacctggcctggaagaaaattttaactaaataacaggtgtctttctctctttctttctttttttttttttttwttgagacagagtcttgctctgtctcccaggctggagtgcagtagtgcgatctcagctcactgcaagctccgcctcccaggttcacgccattctcctgcctcagcctcctgagtagctgagactataggcgcccgccacaccccgctaattttttttttttttgtatttttagtagagacggggtttcactgtgttagccaggatggtctcgatctcctgaccttgtgattcgcccaccttggcttcccaaagtgctgggattacaggcatgagccactgcgcctggcaataataggtgtttttaaagtataatattaacaactgctattagtaagtttttcgttgtttttgttttttttttttttttgagatggagcctggctctgttgcccaggctggagtgcagtggtrcgagcttggctcactgcaacctccacctcccagattcaagtgattctcctgcctcagcctcctgagtagctgggattacatgccaccatgcccagctaatttttgtatttttagtagagacaggatttcaccatgttaggcacactggtctcaaactcctggcctcaagtgatttgcctgctgtggcctctcaaagtgctgggattacaggcgtgagcctctgcacccggcctagagtcccttttataagggccctaatcccattcatgagcaatccactttcataacctgatcatctcctagaagcttcacctcaacaccatcacctcggaggttaagatttgaacatatgaattttcagggggatgcaaacattgagtccattgcagggtaggattattctgtgcactgtgaggggtgtcctctgcactgtagagtgttgagcagcatccctgacctccacccactagatgtcagtcacactccttcccagttgtaacaaccaacaatatctccagacattgcccaatgttccctgggggccattggcatagcaggctaggacactgattgcttcatatacctcctccctacccaattcttagccctaccccagtgcacaagattagggatatggaagagagaagaaaatgaatcaggagagctgacctgtctgaggacagagggatctgggcagggtgagaacctggggcttgatctcccaactctcagagactctgtttagagagttctttattttgtcctttctccttcctctcatccttccctcctcttccttttactctgtttctccttcttctccaactctaccttcatgagttgacacaaagtaattacttttcagtctttctcatcttaaatataaacacttggctgggcacagtggctcatgcctgtaaccccagcactttggaaggccaaggcaggcagatcacttgagcctaggagtttgagaccagcctgggcacatggcaaaaccttgtctctacacaaatacaaaaattaaccatgtgtggtggctcatgcctgtagtcccagctacttgggaggctgagactggaggattgcttgagcctgggaaggttgaggctgcagtgagctgtgattgtgccactgcactccagcctgagtgacagagtgagactctgtctctaatttaaaaataaataaataaataaataaaaacacttaagccattagaggattatgaattttcctctgagtactgctttggctgcagtcacattgtgctatgaagtatttccagtattgctcactgccaaataggttctaacttttggaatgatgcccattttgatgtatgacctgtccaggaaacctcttgatttggtggccagccctgatgagcctgtccatggaagtgttctccatctttcaagccctctctatataaaacaggaaccttcttgtgcccctccgtctgctccccagtggctcctggatgcttcagtcccccaggctcttcctgctggggccacacgtttagcaggcctacagggttcctagtttcccaactcctaatcggggaattggcagattaggcttcatactgtagtttggatacacatggaagcatttcaagatgtgattggatgaggaagattggaatgctggccccagggcctctgtcagctggcagccaccccagaggccctgacccactcacatgcataacccctgagagcttgtcctggggctggtatagaagcagcagctttgtaaaactcaaaaccatgaaggcaattgtaaatcacaatggagaaaggcataagaaatgccttcaaaatcaagtgcccatgcttttttgtaattggaacaaacacatccttattctgagagcaacatgtatatatatacacacatgtgtgtgtatatatgcacatatatacacacacatgtgtgtgtatatatgcacatatatacaagtatatacacgcacatatgtgtgtatatatatacatatatatatattttttggtgagacagagtctcactctgttgcccaggctggagtgtagtggcgccatcttggcttactacaagctctgcctaccggtttcatgccattctcctgcctcagcctcccaagtacctgggactacaggcacccaccaccatgcctggctaatttttgttgtattttttagtagagacggggtttcaccatgttagccaggatggtctccatctcctgacctcatgatccgcctgccttggcctcccaaagtgctgggattacaggcatgagccactgcacctggccatatatttttaattatatatgtattttctttttttaaaaaattatactttaagttctagggtacatgtgcacaatgtgcaagtttgataggtatacatgtcccatgttggtttgctgcacccatcaactcatcatttacattaggtattactcctaatgctatccctcccccggccccccaccccccgacaggccccagagtgtgatgttccccgccctgtgtccaggtgttctcattgttcagttcccacctatgagtgagaacatgcagtatttggttttctgtctttgtgatagtttgctgagaatgatggtttctggcttcatccatgtccctgcaaaggacatgaacgcatccttttttatggctgcatagtattccatggtgtatatgtgccacattttcttaatccagtctatcattgatggacatttgggttggttccaagtctttgctattgtgaatagtgccacaataaacatacgtgtgcatgtgtctttatagtagcataatttataatcctttgggtatatatccagtaacgggattgctgggtgaaatggtatttctagttctagatccttgaggaatcgccacactgtcttccacaatggttgaactaatttacactcccaccaacagtgtaaaagcattcctatttctccacatcctctccagcatttgttgtttcctgactttttaatgatcgccattctaattggcatgagatggtatctcattgtggttttgatttgcatttctctgatggccagtgatgatgagcattttttcatgtgttggatgcataaatgtcttcttttgagaaatgtctgttcatatcctttgcccactttttgatggggttgtttgtttttttcttgtaaatttgtttgagttctttgtagattttggatattagcgctttgtccgatgggtagattgcaaaaattttctcccaatctgtaggttgcctgttcactctgatggtagtttcttttgccatgcagaagctctttagtttaattagatcccatttgtctattttggcttttgttgccattgcttttggtgttttagtcgtgaagtctttgcccatgcctatgtcttgaatggtattgcctaggttttcttctacagtttttatggttttaggtctaacatttaagtctttaatccatcttgaattaatttttgtataagatgtaaggaagggatccagtttcagctttctacatatggctacccagttttcccagcaccatttattaaatagcgaatccattccccatttcttgtttttgtcaggtttgtcaaagatcagatggttgtagatgcgtggtgttatttctgaggcctctgttctgttccattggtctatatatctgttttggtaccagtaccatgctgttttggttactgtagccttgtagtatagtttgaactcaggtagcgtgatgcctcccgctttgttctttttgcttaggattgtcttggcaatgtgggctctttttggttccatatgaactttaaagtagttttttccaattctgtgaagaaagtcattggtagcttgatggggatggcattgaatctataaattaccttgggcagtatggccattttaactatattgattcttcctatccgttagcatggaatgttcttccatttgtttgtgtcctcttttatttcattgagcagtggtttgtagttctccttgaagaggtccttcacatcccttgtaagttggattcctaggtattttattatctttgtagcaattgtgaatgggatttcactcatgatttggctctctgtttgtctgttaattggtgtataggatttttgtgatttttgyacattgattttgtatcctgagactttgctgaagttgcatatcagctgaaggaggttttgggctgagatgatggggttttctaaatatacaatcatgtcatctgcaaacagggacaatttgacttcctcttttcctgattgaataccctttatttccttctcttacctgattgccctggccagaacttccaacactacgttgaataggagtggtgagagagggcatccttgtcttgtgccagttttcaaagggaatgcttccagtttttgcccattcagtatgatattggctgtgggtttgtcataaatagcccttattattttgagatatattccatcaatacctagtttattgagagtttttagcatgaagggctgttgaattttgtcgaagaccttttttttttgagatggagtctcactctgtcacccaggctggagtgcagtggtgcgatatcggctcactgcaagctctgcctcccaggttcacaccattctcctgcctcagcctcctgagtagctgggactacaggcgcccgccactatgcccggctaattttttgtatttttagtagagacagggtatcaycgtgttagccaggatggtctcgatctcctcaccttgtgatctgcctgcctcagcctcccaaagtgctaggattacaggcgtgagccaccgtgcccagcccgaagaccttttttgcatctattgagatgatcatgtggtttttgtcaatggttctgtctatgtgatggatttcgtttattgatttgtgtacgttgaaccaggcttgcatcccagagatgaagctgacttgatcgtggtggataagaagctttttgatgtgctgctggattttgtttgccagtattttattgaggatttttgcatcgatgttcatcaaggatattggtctaaaattctcttttttttgttgtgtctctgccaggctttggtatcaggatgatgctggcctcataaaatgagttagggaggattccttctttttcttgattagaatagtttcagaaggaatggtatcagctcctctttgtacttctggtggaattcagctgtgaatccttctggtcctggactttttttggttggtaggctattaattattgcctcgatttcagagcctgttattggtctattcagagattcacgttcttcctggtttagtcttgggagggtgtatgtgtccaggaatttatccatttcttctagattttctggtttatttgcgtagaggtgtttacagtattctctgatggtagtttgtatttctgtgggatcggtggtgatatcccctttatcattttttattgcgtctatttgattcttctctcttttcttctttattagtcttgctagtggtctatcaattttgttgatcttttcaaaaaaccagctcctggattcattgatttttttgaagggtttttgtgtctctgtctctttcagttctgctctgaccttagttatttcttgccttctgctagcttttgaatttgtttgctcttgcttctctagttcttttaattgtgatgttagggtgtcgattttagatctttcctgctttctcttgtgggcatttagtgctataaatttccctctacacactgctttaaatgtgtcccagagattctggtgtgttgtgtctttgttctcattggtttcaaagaacatctttatttctgccttcattccgttatttacccagcagtcattcaggagcaggttgttcagtttccatgtggttgtgtggttttgagtgagtttcttaatcctgagttctaatttgattgtgctgtggtctgacagtttgttgtgatttctgttcttttacatttgctgaggagtgctttacttccaattatgtggtcaatttcagaataagtgtgatgtgatgctgagaagaatgtatattctgttgatttaggatggagagttctgtagatgtctattaggtctgcttggtgcagagctgagttcaattcctggatatccttgttaaccttctgtctcactgatctgtctaatattgatagaggggtgttaaagtctcccattagtattgtgtgggagtctaagtctctttgtaggtctctaaggacttgctttatgaatctgggtgctcctgtattgcatgcatatacatttaggatagttagctcttcttgttgaattgattcctttaccattatgtaatggccttctttgtctcttttgatctttgttggtttaaagtctgttttatcagagactaggattgcaacccctgcctttttttgctttccatttgcttggtagatcttcctccatccatttattttgagactatgtgtgtctctgcacatgagatgggtctcctgaatacagcacaataatgggtcttgactctttatccaatttgccagtctgtgtcttttaattggggcatttagcccatttacatttaaggttaatattgttatgtgtgaatttgatcctgtcattatgatattagctggttattttgcccattaattgatgcagtttcttcatagcatcaacggtctttacaatctggcatatttttgcagtggctggtactggttgttcctttctatgtttagtgcttccttcaggagctcttgaaaggcaggcctggtggtgacaaaatctctcagcatttgcttgtctgtaaaggattttatttctccttcacttatgaagcttagtttggccggatatgaaattctggattgagaattcttttctttaagaatgttgaatattggcccccactctcttctggcttgtagggtttctgccaagagatctgctgttagtctgatgggcttccctttgtggttaacccgacctttctctctggctgctcttaacattttttccttcatttcaactttggtgaatctgacaattatgtgtcttggggttgctcttcctgaggaatatctttgtggtgttctctttatttcctgaatttgaatgttggcctgccttgctaggttggggaagttctcctggataatatcctgcagagtgttttccaacttggttccattctccccatcactttcaggtacaccaatcagacgtagatttggtcttttcacatagtcccatatttcttggagactttgttcatttctttttactcttttttctctaaccttgtctttttgctttatttcattaatttaatcttcaatcactgataccctttcttccacttgatcgaatcggctattgaaacttgtgcctgcgtcacaaagttctcgtgccatggttttcagctccatcaggtcatttaagttcttctctatgctgtttattctagttagccattcgtctaacctttattcaaggtttttagcttccttgcgatgggtttgaacgtgctcctttagctcagagaagtttgttattaccaaccttctgaagcctacttctgtcaatttgtcaaagtcattctccgtccagctttgttccattgctggcaaggagctactatcctttggaggagaagaggcgcgcaggtttttagaattatcagcttttctgctcttgtatctccccatctttgtggttttatctacctttggtctttgatgctggtaacctacagatggggctttggtgtagatgtcctttttgttgatgttgatgctattcctttctgtttgttaattttccttctaacgtcaggtctctcagctgcaggtctgttggagtttggtggaggtccactctagaccctgtctgcctgcgtatcaccagtggaggctgcagaacagcaaatattgcagaacagcaaatattgctgcctgatccttcctctggaagcttcgtctcagaggggtacccgcctatatgaggtgtttgtcggcccctcctgggaggtgtctcccagttaggctacatgggggtcagggacccacttgaggaggcagtctgtccgttctcagagctgaaacgccatgctgggagaatgactgctgtcttcagagctgtcagacagggacgtttaagtctgcagaaactgtctgctgccttttgttcagccatgccctgctcacagaggtggagtctatagaggcagtaggccttgctgagctgcagtgggctccgcccagtttaagcttcccagccactttgtttacttactccagcctcagcaatggtgggcacccctcccccaaccaggctgccacgtcgcagttcgatctcagactgctgtgctagcagtgagcaaggctctgcgggcgtgggacccgcccagccaggcatgggagagaatctcctggtctgctggttgctaagaccatgggaaaagctcagtatttgggcgagagtgtcctgtttttccaggtacagtctatcccggcttcccttggctaggaaagggaaatcccctgaccccttgtgcttcccgggtaaggcgacaccccgccctactgcggctcatccttcatgggctgtacccactgtccaaccagtcccaatgagatgaaccaggtacctcagttggaaatgcagaaatcacccatcttccgtgtcaatcacactgggagctacagactggagctgttcctatttggccatcttggaatagccccaacatatttttttaaccatgtaaatgtggttaacatttttttcaagcagtagaagaggatatataatgaaatttaagtctccttcccaccctcagaccctccattcccttcttcagaagggaaagctgaataattttttttttttgaggaggagtctcactctgttgcccatgctggagtgcrgtgatgggatctcagctcactgccttccatgttcaagtgatactcctgtctcagcctcctgagtagctgggattacaggcctgcaccaccaaacscggctaacttttgtatttttagtagagagggggtttcaccatgttggccaggctggtcttgaactcctgacctccagtgatccacccacctcagtctcccgaagtgctgggattacaggtgtgagccactgtgcccagtctgaataatttcttagatattcttctgtgcatatgtaggattaaaaaaaaaaagaatagaagaataccataatgtcattttgtacatttcttttgaaagttaacaacaagtcttggaaatcattccatatcagtaaatgcatgtttacctcactcttttttttttttacaaatatataatagtccaccaatgaatatactatcatttgattttccagtcctcctaatgatggagatttgggctatttgctaattttcctagtgccacgatgaaccactccatctctctgtgtttgcacacacgtctgcgggtgtttccggggtctgctcctaggagaggtgttgatggttgaaaggataggagcatttttatttttgccaaattttgagaaagccttttttttttttttgagaaaggagaaggagcagcctttgaggagggtgaactgtgaggcttctgaggctcaaacaagaatgcatgaaggcactccttaggaaacagaggatgggtgagcaggaggtggagagttcagtgtgatgatgaagatgaacgtggtaaaacccagggagggaaattagcaaagggagggatatagggtggcccctgcaggcctttatcccttctgcatccaggagaggaggcacgactgtttaaagatggactctgccaagcctttgataccttgcttcttctattcttaagtagaatgttaacgctgccaggtaaaagagttaacaagttacatccttgagcagacacttttcaaagaagatacacatgcaggccgggcgtggtggcttatgcctgtaataccaccactttgagaggctgaggtgggtggatcacaaggtcaggagttcgagaccagcctggccaatatggtgaaaccccatctctactraaaatacaaaaattagccggacatggtggtggacgcctgtaatcccagctactcaggaggctgaggcaggagaattgctcgaacctgggaggcggaggctgcagtgaaccgagattgtgccattgcactccagtctgggcaacagagagagactccatctcgaaaaaaaaaaaagaaaatatacgtgcagccaacaagcatatgaaaaaaacctcaatgtcactgaactagagaaatgcaaatcaggccaggcacagtggcccacacctgtaatcccagcactttgggaggccgaggcgggtggatcacttgatgtcgggagtttgagaccagcgtggtcaacatgacaaaaccccatctctactaaaaatacaaaaattagccgggcgtggtggcacacctgcaattccaggtgtaattcaggaggctgaggcatgagaatcacttgaacctgggaggtggaggttgcagtgagcagagattgcaccactgcactccagcctgggtgacagagcaagactccatctcaaaaaaaaaaaaaaagggaaatgcaaatcaaaaccacaatgagatgccatctcatgccagtcagaatggccattattaaagagtcaacaaataagctgagtgtggtggctcatgcctgtaattccagaactttgggaggccgaggcaggtggatcacctgaggtcaggattttgagaccagcctgaccaacatggtgaaactgcgtctctactaaaaatacaaaattagctgggtgtagtggcaggcgcctgtaatcctagctactcgggaggctgaggctggagaatcgtttgaacctgggaggcagatgttgcagtgagctgagattgtgccattgcactccagcctgggtgacaagaaggaaactccatctcaaaaaaaaaaaagaaaaaaaaagtaaaaaaataacagatgttggtgaggtagtggagaaaaggggatgctatgcatagttgatgggagtgtaaattagttcaaccattgtggaaagcagtgtggtgattgctcaaagaactaaaaacagtactaccatttgagccagcaatcccattactgagtatatactcaaaggaatataaatcattctaccataaagacccatgcacacaaatgttcactgcagcactatttacaatagcaaagacctggaatcaacctaaatgctcatcaatgacagattggataaataaaatgtggtacagaaataccatggaatactatgcagccataaaaaagaacaaaatcatgtcttttgtggaaacatggatggagctggagsccattatccttagcaaactaatgcaggaacagaaaaccaaatactgcatgttctcacttataagtggaagctaaatgatgagaacacatggaaacaaaagggggaacagacacaggtctacttgaggatgggggatgggaagacagagaggatcagaaataataactattgggcataggcttagtatctgggtgatgaaataatctgtacaacaaacccccatgacacacatttacctatgtaacagacctgcacatgtacttctgaacctaaaataaagtttttaaaaaaacaagttatgtcctaatcaagtagactgttaaccctgccaggtaagagaattaacatgttatatcccagtgaagtacaatgttaacccttccaggtaaaagaaattaacgcgttatatctgatcaaatagaatgcaaagctgctaggttcacataagatttgttatgttcatgaaaccttaatcgtttctttttttcttttcatagaacagagaagagaaaaaggactttcttccccgaaacatggatttggcattgtctcaacatcaggtacattaagatttcttttctgcgctgactttgccggttgastgaaagacactcatgcgggtcyagagagcctccggtgagrtgggcaggcctgataccaacatctgagcaagacactgtgcatctttttctaacacayaaaacttcaagccatgaagccagccttgagtcccgctgcacatttggacgtttgcctgtgaaatatgaaatgcaagggctttgtgcctcttataactccctcttggggttactctatctgctctgtttgtataacgagctcattaaaatgattacagttccctggaacatgaacttgactccacctacccccactccttgctcctcaggggactacagctcttgctcaaaaaacaggatgcctttctcaacacatttcctttctgcatttttccccgtttagttctctttgaagcaggagtgtaggcaacccttttctgctggatgcaattgactttttttcttgcaatgctcagcgttagagcaccaatgacactagtaaaaagtggcactggcgtgccccggcaaaccagtttggcatgaaaactgactcttggtccagcccgggccagcaggtgggctgactgctggagctgtgcccttcctccaggcacaaggtgctgtggcaagtgcttggcagagccaggcacgcagctgggggcccctcagactgctttgggggatgtgtatgtcctcatcgtgggaaggtttgactgctgatcagaacacatccagttcactgtgttttgttctgggggcccagctgtaagacaggctatctgtccatcatcattcaaatgtatctactttctggatgtctggtgagctttttttattgttaaaaaattttttcaattaacttttattagggctgggcatggtagctcatgcctgtaatcccagcactttgggaggctgaggcaggtggatcacgagatcaggagatcgagaccaccctctctaacatggtgaaaccctgtctctactaaaaacgcaaaaaatagctgggcatggtggcgggcgcctgtagtcccagctactcgggaggctgaggtaagagagtggcatgaacctgggagacggaggttgcagtgagccaagatggcgccactgctctccagcctgggtgacagagcaagactccgtctcaaaaaaaaaaaaatatttcatagagatggggtctctgtatgttgcccaggctggtctgaaactcctggcctcaagtgatcttcctgtcttggcctctcaacgtgttagaattacaggtgtgagctactgctcctggcccggatgtttttgatgttaaggatggtcccttgaataaggtagacagagtcccagcactcataacattttcattgtagctagagtagacaggtgcctaaagagccatcatggtgcagtggggttagtcttctggaaggctgggcatggagcttgggaggcagagaaagatggtggaatcctttggaaaagccagagagggtcctcaatgtagggcccaagctgagtcccaccatatgaataagcaagaaagggaagggtgtccaggaaggaccagcatgagcaagtgctgcaaagtaggagaggctggtggatttccacatggttgaaatgagatggaaggagctgaggaggatgcagggagtatgagaccatgtgggctgtgggggtggggttaggggtgcaggtgtggagagccagggatttgggatttaggattcgggatgttctctctcctctcttgttggctggagcaaggatgaatcagaggggacagatctgagaccagggaggaggttcctgctggacccaaaagaggactggtcaactctcttttaaaccacacccgtttaaaggcggggtgtggtggcttatgcctgtaatcccagcactttgagaggctgaggcaggaggattgcttgagcccaggagttcaagaccagcctgggcaacatagcaaggccccatctctaaaaaaaatttttaaattagccaggtgtggtggcacatgcttgtggtcctagctacttgggaagctgaagtgggaggatcgcttgagcccaggaggttgaggctgcagtgacacgaaattacaccactgcactccagcctgggctacagagtgagaccctgtctcaaaaagggaaaatgattcaaaaatgaattggtttaaaaaattatggtgaaatactccacataaaatttacgatcttaaccatttttaagtgtatagttcagtggtattaaggacactcacgttattgtgccaacatcaccatcacccatttctgtgactcctttcatcttacaaaactgacactctgtcccattaaacactcactcccctctcttcccttcccccagcctttggtaacaaccctttctgtctctgagtttgactattctagggaccgcctgtaagtggaatcatgtagtatttgtcgttttgtgactggcttatttcaacatgtccccaaggttcatctttgttggagaatccatgtcagaatttccttctctcttttttttttttttcttgagatggagtcttgctctgtcaccaggctggagtgcagtggcacaatctcggctcactgcaacctctgcctccagggttcaagtgattcctctgccttaaccttccaaatagctgggactataggcatgcgccaccatgcccagctatttttgtgtgtttgtgtgtgagacagcatcttgctctgttgcccaggctggagtgcagtggtgcgatctcggctcactgcaaactctgcctcctgggttcacgccattctcctgcctcagcctcctgagtagctgggaccacagccgcccaccaccatgccctgctaattttttgtatttttagtagagacggggtttcaccgtgttacccaggatggtatcgatctcctgacctcgtgatccgcccgcctcggcctcccaaagtgctgggattgcaggcatgagccaccgtgcccagccaatgcctagctaattttttgtattttagtagagatggggtttcaccatgttgaccaggatgatctcgatttcctgacctcgtgatccacccccctcggcctcccaaagtgctgggattacaggcgtgagccactgtacccagcctccttcccttttaaggttgaataatatcctattgcatggattccctcattttgtttatccatttattttctgtcgatggacccttgagttgcttccaccttttggctattgtgaataatgctgtgaacaggggtatacaaatatccctttgagaccctgcttcccattcttttgggtgtatacccagaagtagaattgctgaatcatgtggtaattttatgtttaattttttaaggaacctccagactaatttccacagcagctgcagcgttttacatttctactaacagtgtaccagggttccaatcttaccacatcctcagaaacacttgctgttctctttttctttcttttctttttttttttttttgagatagagtctcgctctgtcacccaggcaggagtgcagtggtgcaatctcagctcactgcaccctccgcctcccaggttcacacaattctcctgcctcagcctcccaaatagctggaactacagacacgcaccaccacacctggctaattttcgtatttttagtagagacggggtttcacccactacttctgggtgtatacccaaaagaatgggaagcagggtctcaaagggatatttgtatacccatgttcacagcgttattcacaatggccagactcctgacctcaagtgatccacccacctcggcctcccaaagtgctgggattataggtgtgagccaccatgcccagccttttttcttgccttttcttttttaatatcctaattaagtacatgaagtggcatctcattgtggtttttatttgcatttccctaatgattagtgatgttgagcatctttcatgtatttatcagtcatttgtctatcttctttggtgaaatgtctattcaagtaatttgcccatttttgaatcatgttgctgtttttgttattgagtttcaggagttctctatatattctggatattatttccttatcagatatatgacttgcaaatattttctcccactgggttgactttttactctgttgatagtgccttttttttttttttttttgagacaaggtctcactctgtcacccaggtgttcaagtgatcccccaacctcagcctcccaagtagctgggtctacaggtacacaccaccactcctggctaaattttttaattttttgtaaagatagggtcttgctgtgttgctcaggctggtctcaaactcctgggctcaagtgatcctccttccttggcctcccaaagtgctgggattacaggagtaagctaccatgccagcccttgaatagtgtcttttgatgctcaaaattttgcagttttcataaagtccaacttgtctactcttttttttttttttttgcttgtacctttgttttcatatccatgaaatcattgtcaaacccaatgtcatgaagcttttgccctgttttcttctaagagttttatagttttagtttttactttcaagtcatggattcattttgagttaacttttgtatatggtgttaggtaaggtccaaattcattcttttgcatatggatgtttgctttttctagcagtatttgttaaaaagattgtcttttccctaaagtatcttgatgcccttgtcaaaaatcatttatctgtgtcgtcaaggtttattcctgggctctctatttgattccattggtctgtatgtctgtctttatgccagtaacacattgatttgaatatggtagctttgtggtaagttttgaagtgtgagctctccagctttattcttctggtttctttgtttggccaccaggatcccttgagatccatgtaaaatctcaaggtggagttttctatttctgcaaaataaaataaaataaaaagtcattggggtttatgataggggttccattgaatctatagatcactttgggtagttttgacattttaacaagtctttccgatccatgaacatgggaaatgttttcatttatttatgtctttttttgtcttttttagtttctttcaataatatttttgtgtgtgtgtgacagggatctcactctgttgctgaggctggactgcagtggcgggatcacagctcactgcaccctcgaccacctgggctcaagtgaatcccccacttcagcctcctgagtagctgggcctacaggcatgtgtcactatacccacctaatttttaaattttttgtagcaacacggtctcatcatcttgcctagggtggtccggaactcctgggctcgggcagtctcccacctcggcctctcagagtgctggtattacaggcatgagccactgcgcccagcccatgttttctattagagtcagggctgagggacagtttttttcctgttgccgcttttrtgatgccttcaatgcttgtttctaagctcctagggtgcctctctgagccatgcagcctgggtcatccatgcccactggcccccctgaggcatggccctggagaagggccccccatcatggctgtctgtctctccgcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagrtcccgctcagtgtctacaactacatgggcacctgcrctgaggtactcagccccccaaatacatagccttcctccattcagtggggagttgggactgcattggtgctataaggtaggcaggggtgggacagtgtcagcttgggggatttaggagggcgagagcctctatgatgttgrggaggcagggatgggtgggctcagcctggggggctttggggaggatgcgtcatctgtgctgtcagggaggcaggagtgggatgagatcagcctctgattcaccaaccgtcaaagccgggtgaggaggaggtggggacgcatgtgtgtgagtgagagggacttggtgtaagtggagctgttgtccctgactccctggcctagcaagggcgtgcctggactggtatcatatatgatagcatggagctttctctgtaaagggccagataggaaatatttctgtctttgccagccacacaatccctgtggcagcgactcaactcagcccttatagcataaaagcaacctagatgatctcttacctgaatagatatggctgtgttccaataaaacttgatttctagacactgaaatccgaactccatagaattttcacctgtcacaaaataatcattcttcttttaattttttttcctcctaaccatttgaaaaagatgaaaaccatctttagcttgtgggcccaaaagacaggtggtggatccggtttggcctatgggtcttaattcacagrctccccacaaagtaccaggaaatcctggtggtgaacagagagggtgcttgggatcccggtttatactcatagagctgctgatcttgggcacgttattcaatctgttggtgtgtcggagcctcgctgggcgttaaagggttaaatgagttagtctcagtagacactgagaacattaagcagggctgtttttcgatgatattattggggttccagtgtctgccagaggtgtgcagtgaaggccaaagctctctcttggaggcggcaggaaaggctgctgtcctagtctccttgggctagtaaggtagcccaaaccaggtggcttaaaacaacagaaatgtattgtcccacagttcacgagaagaagtgtgaaggcaaggtgtcatcagggctggtcccttttggaggccctgagggagaatctgtctatgcctttctttctctctctttctcttttttttttttttttttttttcgagacagggtcttactctatcacccaggctggagcgcactggtacaatcacagctcactgcagccttgacctcctgggctcaagcaatcccccctcctcagcctctcaagtagatgggactacaggtgtgcaccaccatgcctggctaattattttattttattttcgtagagatggcatctccatatgttgctcaggctggtcttgaactcctggcctcaagtgaccctcccacttcggcctgccagagtgctgggattacaggcatgagccactgcatttggcccctctctccctgtctcttggcttctggtggcttgtgccagtatcagaagatcccgtcatgcaggatgtgagatccaagctcaaccttggagcgaagtggtttgtgtttagatcccactcactcagttttggtggggcatgtacttctgcagctggtgctggactgacaattttacctgcattattatttatttatttatttatttatttgagataggatctcgctctgtcacccaggctggagtgcagtggcgtgatcttggctcactgcaacctccgcctcccgggttcaagcgattctcctgcctcagcctcctgagtagctgggattacaggcgcccgccaccacgcctagctaatttttgtatttttagtagagacggggtttcactatgttggccaggctggtctcgaactcctgaccttaagccatctgcctgccgtggcctcccaaaatgctgggattacaggcatgagccaccacgcctggccaccttcatcattttatcaagctcctgtgtgggccaaggaagaagggtctgtgatggaatcattcaccattaggaagctcaaagaagcattgtcatgggttcaggggcctccagggagtgagtggtggagctgtgtgttagaatcaatgtctacgggtgccgggacagcccagaaaaggggaagtccccctgaacctgagagtctgcaggtgatgtttgagtcaggcatcggggcgggaagggcattcgcaaagagggaacagcatgtacaagcaacagaagcaggaggcagcttgacctttcctgggtcctgcctcagacatagtttggcttggctttggggtctggtcagggaagatggaaaagcaggtgaggagcaagaggacgaggaggtcagaggctcctgccattgtctaggcaagaggcaaggaggcaggaagcaaccaaggcagcggtcacagggtggcttcggtgaggagtaaatgggagatgttagactcagaatggccaggtagtggtgcccagaatcctagcttcagtcccaacctttacaatccatcctttaccgttctttttatatggattatggttgggaggaataggatctcggtttccaaaagaaagcatacacacagactatgccctgacctgtaggttggcccctaaagggaggtttccctctgaaacctgtgagcagaatccccagatgtccggcttggctctgagcgcatgctggtgtctagcttttccagcaggaagaaggaagtcctgctgggcagtgtatgtgcttaaggaccaccccagcttgtatgaccatccccaagacagagaaaacatacccattcagaccctccagtggggagcgctggtcatttcactcaggacctggaaaatggctcattgacactgttgagtttctttctttctccttccttcctcccttccttcctccctccctccccccctcccgtccttccttccttctttctttcttttctttctttcttttcttttctctctctttctttcttttctttctcccttcccttcccctccccctcccctcccccctctgctcctctcccctccactccccttcctttcccttcccttcccttcccttcccttcccttcccttcccttccctttcctttccctcccttcccttctcttcccttctcctcccttcccttcccttcccctctcttcccctctcttcccctcccttcccctcctttcccgtcttttctcctccttaccccttctttccttttcttcttcttttgatggagtctcgctctgttgcccaggctggagtgcagtggtgtgatcttggcttactgcaacctccacctcctaggttcaaggattcctctgcctcagcctcctgagtagctgggattacaggtgcccagcactacgcctggtctttagtagagatggggtttcctcatgttggccaagctggtgtcaaactcctgacctcaggtgatctgcctgcctcagcctcccaaagtgctgggattacaggtgtgagccaccgcacccagcctctttctttcttcctgggaaaatgctaccttgagggggatgtggggattcctgatgtgcaccctgcagcagccattggctctcagatctagctgggcctttcctttgtcaggattcaggactctatcatgtatgccacttcacattttccccgcatgcttctctccacatcacacctgcagcctctgtgccagtccttgggtgggacaacattctgaggctcagcaatcactcatgtcttgatcagccatttctttaattcctagcggggcacccagtaggtgctccatatatgctggttggacaaatggatgtggagcaaagatttcctcttagatggaggggttgcaaacgtgcttgcatatgcacccacartrcacatrcacacaccctgcaaaatgcacacacatgcacacagagaccagtatgtgtgagcatgcacatgatgcacccacacaagtcgtcatggtatacatatgcacatgtacatgcatgatacatgtatacacatgccatacttgcacatccatgcacagacatgcacatggagtcccatgggtgcatccatagcacctctgtacccatataggcacacacatgcatgcagaaactagcatgcccatacacacacacacgaatgcatatccacatgccttcacccggtagatgcacatgtgtgtacatgcatgcatgcacatgtgtatgcagtctgtgcttgcatccatgcacacaagtgtgcacccagggacacatgcattcacagcacacacatgcacatgaataaacacacacgtgcacacacagagctgtactctgacatcatggagctgcacggttggaaagagggtcaggagaggcactctgtggacctgctgtgggagaggttacatccatctggagtcccggagtggatggacatgcaggagaggcagccctggctggaactggcagcttcagtccatgggagatctggacctgtgaggatacggagggctgtggggaggagaggtctcacagcaagacagatgggcatgagaaggccaagtggggcaccagacagcagagggtagtttgttctgatcggaaatggaaaggggaccttcccggggggagcatggctctttgggaggctgacaagtctggtgtgtgcagtgagtggtgggatgtgtgttgggcctccaggcactgggagggggtctggattccaggcgccatgagccaatgccaccctctgcaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacgggtgaggaccccacagttcttggggtgtcccccctctccaggccacaaaagtgtcctggcattgacccgagttggggatgaggggtggatggggcagcaggtaaggtcaggactgtcccaaggaaaatgggacagcaactggggcaagcaggacagaaggaatgggcccaggaggagtggggaggcaagccctggggtctcacctgttgggggagctgggctcttaaggtgccaacccagtgtagcacacacacatgcagacatgcatacacacacaaatccacacacacgcccacatgtgtagacatgcacacacacaaatccacacacacacgtccacatgtgtagacatgcatacacacaccacaaatccacacacacacccacgtgtagacatgcatatacacacacacaaatccacacacatgtccccatgtgtagacatgcatacacacaccacaaatccacacacacacgcccacgtgtagacgtgcatatacacacacacaaatccacacacacgcccacatgtgtagacatgcattcacacacacacacaaatccacacacacatgcccacatgtgtagacatgcatacacacagatccacacacatgcccacatgtgtagacatgcattcacacacacaaatccacacacatgcccacatgtgtagacatgcatatacacacacacaaatccacacacacacmcccccacgtgtagacatacatacatatacaaacaaatccacacacgcacatgcctgcatgtgtagacatgcatcacacacacgaatccacacacacacatgcccacatgtgtagacatgcatcacacacaaatccacacacacagacacatgcctgcacatgcagacatgcacacacacacacaaatcatacwcacacacatgcccacatgtgcagatatgcattgcacacacgaacctgtacaaacacatgcacacacatacacacatgcatatacacatacaaacttgtacacacaaacatggaaaaatgcacacacatgcatatacacacaaacacacgtacagatacacacatgcatatgcacacacaaatttgtacacacacaaatgcacacacaaactcgtgcacacaaatgcacacacgtgcatatgcacaaactcgtacacacaaacacatgtacaagtgcatgcatatgcacacatgagcctgtacattcaaacacatgcatacatgtgcagacatacacacttgcatgcatgcacacatctgcatatacacacacacatgcacacacacacacatgcatgcatgcacacacatctgggataaggatagggatgggacagcccccatcttgggtggagacctgttctgagaccaagacatcaaatttctgcagccaaagcccttgcttacggagacacaaattgctgccgggatgggaggtccagcaaacaccctgaggagaatcacgccgacaggagggtccccatcggggtggatcacgtcaggcgcagtgtgatggttgaggtaaggccgtgtcctcatctctggtgcttagccagggcctcattccttcagccatgaagctgggsccagctggagtgtgtggtctgaggctgagccagggcctgggcagccttcacgggttgtgcttgagagctcaggtgcctggactttcgggtacttccttgttagaggatcatggtagtccgttccctccctaaagcgcagagtgggcttyggtaaagcagcttgggactcttcaggggctgcagcaagtgctccctgacccctgggtgaactatttaggaagaccatgtccctcatctcgtgcttgtcataggcatttatggggaccatgactcagcatttggggcattgtcattggatggcctgtgtaggaaggacacagagctgcagggggcagaggcaggcgccaggatcttgcagacccccagctatgaatccaggattggccacttacccatgatctcgggaagcatcctggctttccagccccgctctgtaagacgaggggctcaccttcataagatggggtgggaagccagagatgacacacagatgtctcagggctgagcatgcagcagccaccatgcctcatcttttcttggctgcttggacacatcagagccctactgaggctccatttggtgccgcaccaacagcccctaacagcagcccgaagggactcacattccccagaggcccagctgcaaacagctgctctccctccctgctgggatcctgctggccctgaacacaagtggcttctgtcagcaccaggagtcatgtgcccactgggcagaactccggagcggtgacagtggacaggtcaccgctgtagtgtcgttgatgtgatgtgatggattccttggggacaagagtgctgtcaggtggggaccgagatctctgtgagccagcagggtgggagggtccagatggggaaatgcagagacccccagtcaccctttgcccagccagggcatcctccctgggccacagcctgccctcctaaggcccaagaaggaggcagcgagcccctccgagctgcagaacctggaggcctggcgttcttgcctcctccccttacagaagggatttctcaatgcacacagggggactcttgagggtctccttccctggagcctttcctcccatccatgccgcagaactgtctctgcacctgcagtatccacttgtccggcttcctggaggcagctctggggaaagatacaggcatcagaagacttgaaatgttgatgcaaaagatgaagctacaattagaaaagcaatttatgaaacaagaggcaccaggatgtgtggcttgataaagcagcaaaatgctcctcctacctcttcccaccggaggactgtgggcgccaccagctgagatggacttaggagcaggaagctgaatacgatgcatgggccggtggggaatcatcatctgtgcacggcccatcatgggcactgtaccagggtggggatggcttggcaggtgcagggagtacggacaccgctctgccttgctcccctgctggcctgcaaggggactaagatcctctatatctgctgggaggctgagagtgttcaatcatctccacgtgaatttcacttcagtgaaattccaaggagcaaagaggaggcagaaataattcgggcctcactggagtgataggagggctggccagccagggagtgggctctggagtgagagccccagattcggatggaagcgttggatggttaaatgagagtgttggtggaaagcctctcatggtatctggcctgtctactaaagwcccacgtgctgttgtcacacaggcatttataacagtcaactggggaatcccaraccaaagtcagggatacrctttctattttaggaaatgtccatcagctgatgaattagagaaatgaatgtgggtcaatgaaatgcaattcctcaatgcaatggaatattattcagctgtgaaatggagtgaagggctgggtgtggtggctcacacctgtaatccttgtgctttgggaggctgaggcaggaggatggcttgaggccagaagttggaggctgcagtgagctatgattatgccactatactcagcctggaaaacagagccagaccctgtctaaatgaatgaatgaatgaataaataaataaataaataaagcactgatccatgctacaacgtggataaacctagaaaacgtgataccgagtgaaagaagacagacacaggccgggcacggtggctcacgcctatagtcccagcactttgggaggccaaggtgggcagaccacctgaagtcaagagtttgagaccagcctgggcaacatggcaaaaccctgtccctactaaaaatacaaaaattagctgggcgtggtggcacacacctgtagtcccagctcctcaggaggctgaggagggaggattgcttgagtccaggaggtgagagttacagtaagcaacagagggactcttgcaacactgcactctagcctgggtgagagagccagaccctgtctcaaaaaaaaaaaaaagaaaaaagaaaaaagaaaaaagtcaaacacaaaaggccacatggtgtatgattcaatttatatgaaatgcccagaacaggcaaatccagagaggccgaaaggagtgaagcacagatctgtactacaaggctttagaaatgcccagccggagctactattcgtgcatcatgcaggctccgtgttctgagatctggccccaagccagaaagagcacagagacaaaggaggttggaaccaggatggacaagtgcagcccgagatgggctaacactcaaggagcaaacccaagccacggcagaggggcagagtggaagagatgggcatcattgaggaagccagctgtggggtcctctgtgagctgagtcagcagaggtttcttgggacccagaaaccatgaggggcccctggatttgtgcccagggccccagccaatggtcagccagaggcacagtgcatccttgttgtattagttcgttcttacattgctataaagaaatacctgagactgggttatttatttattartttatttatattattactagttttggggatggagtctcactctgtcgcccaggctggagtgcagtggtgcaatctcagctcactgcaacctccacctcccaggttccagtgattcttctttctcagcctcctgagtagcggggactacaggcatgcaccaccacacctggctaatttttgtatttttagtagagacggggtttcaccatgttggccaggttggtcttgaacgcctgacctcaggtgacccgcccgcctcggtctcccaaagtgctgggattacaggcatgagccactgtgcccgaccatgactggataattagtaaagaaaagaggtttaattggctcacagctctgtaggctgtacaggaagcatggctggggaggcctcaggaaacttacaatcatggcaggaggtgaaggagaagcaggcgtgtcttacatggctggagcaggaggaggagggaaggggaggtgcttcacagttttgttgttgttgttcttgttgttgttttgagatggagtctcgctctgtcgccacgctggagtgcaatggcatgatctcagctcattgcaacctccarcctccttgttcaagcgagtctcctgcctcagcctcccgaatagctgggattgcaggcacctgccaccatgcccggataatttttatatttttagtagaggcagggtttcaccatgttggccaggctggtctcaatctcttgacctcgtgatccactcacctcggcctcccaaagtgctgggattacaggcgtgagccaccgtgcccagccgcttcacagtttcaaacaaccagatctcatgagaactcacccattatcacgagaacagcaagggggaaatccgcccccatgatccaatcaccttccaccaggcccctcttccaacattgaggattacaattcaacatgagatttgggtgggaacacaaatccaaaccatatcactcaccaccaacagaatggatctggttctgtctctatggatttgcccacgggacattttgtatcaatggaatcatacaacatgtggccttttgagtctggcttctctcactcagcacaatgtgttcagggttcatccacggtgcagcatagatacgtgcttgcttctatggctcaatcatattccactggatggatgaaccacattttctttatctgttcacctatggtggacatttaggttatgcacaatttttaggattatgtagctgttaaaaagctaccatgaggccaggcacagtggctcatgcctgtaatcccagcactttgggaggccaaggcaggtggatcacctgaggccaggagttcgagaccagcctggccaacatggtgaaaccscgtctctactaaactatacaaaaaattagccaggtgtggtggcaggcacctgtaatcccagctacttgggaggctgagacaggagaattgcttgaacctgggaggcagaggttgcagtgagctgagactgcrccactggactccagcctgggcgacagagcgagattccatctcaaaaacaaaaaacaaaaaactaccgtgggttacaatggcctagccctgcccattgctccaaatccytttcccgacaaggggccaggcwggtagatggggggttactgaggcctaagcaatgcttctggggccttccctggtgccccctagcttagcaaatgacccgtgggtgccacatcgggcctagcaggtgtgagatgaaatcctggcaggtggacggctcgatgtagcctgagatggtgtcctcagcctctcagcaccaaccctgggaactttactaggaagtggatgtgagtggggacaagcatctcctggactcatcagtatagacacatgacaatttcaaggagagctttgtaatgaaagtaggtaaggatgagaaaatataacaagaactgactgtcagtagcactgagaagactccagaccctttctgaagcatgataaccccgtcacaaggtgaagttgggggtctttaacccccatcttagagatgaagaaatgggggcccagagaggttgagtgagtggccctaagccagtcagcaggaatggttgtattaggattcaccagagaaacagaaatccgcaccccctacatacatagaatgagatttgttatataaacacactcccacacatacatctgtaggataggtttatcataaggtactggctcatgcgcttatggaagccgagaagtttacaagctgccctctgcaagatagagacccaggaggccgggcgtggtggctcacgcctgtaatcctagcactttgggaggctgaggcaggcagatcacctgaggtcaggagttcgagactagcctggccaacatagtgaaaccctgtctctactaaaagtacaaaaattagctgggcctggtggtggtgmctgtaatccctgctactcaggaggctgaggcaggaagatcatttgaactcaggaggcggaggttgtagtgaaccgagatcgcgccattgcactccagcctgggcaacagagtgagactccatctaaaaaaaaacaaaaacaaaaacaaaaaaamcccaaaacaacaacaacaacaamaaaaaagctaaagacccagtaaagccagtggtgtagctggaaggcctgagagctggagaaccaatggtgtagattccagcccaggtctgaaggcctgggaaccaggagcaggagaagatcratgtcccagctcaagcagttgggcagagagtggaaccaatcttcctctgtcttgttctatcaggagacgtttaacagcttggatggtgcccactcacattggagagggccgtgtgccctactcagtcctccaacaccaatgctgatctcttgcagaagcacttcctggacgcgcccagatagagtgtttaaccagctacctgggcatcctggagcccagtccagttgacacctaaaattgaccatcctaggctgggcacggtgtctcatgcctgtaatcccagcactttcggaggccgaggcaggcggatcgcttgaggtcaggagcttgagactagcctggccaacatggcaaaatcccatctccactaaaaatataaaaaattagcttggcgtggtggcatgtgcctgtagtcccagctacttgggaggctgaggcatgagacttgcttaaacccaggaggcagaagtttcaatgagctgagatcactcacaccactgcactccagcctgggcgacagagtgagactctgtccatagatagatagatagatacatagatagatagwtaaataaataaataaataaataaataaataaataaataaaattgaccatcctaatggggaaaggggctgccaggccttctggttgcagctgccccatgttaaccctttgaggtctgatccaagggcccccacaggggccgtgttggtcagaccaagctccgcaaggtatagggggttaaattctgggcatccctttttaagagactgagacagctgccttctggtatttggggtcatccatagaagaagcagaaatgagaacccagatggaagagacaggagacaagagatgtggtagacagacagtgggacggagactcgtccttggcagatgcaggagcccctctcacagtgctcacggatgtcaaatgaggcctcagaacctggcttatttgtcctcatgatgtcctctgyccagagggagatgggaggaagagggtggctgggagggtagggtagggatgtgggccccatgacaagtttagaagcagttggtgagttccttttggccagcaagggggagcagcctcagtttccccattggagcctgggaagtgggtggccctgtcctgctccacgcacctgtgatcttggtgtgaccgtgctgataccacgtaaaacctggaagcacaattatgtggtctggacttgaagtcattgctgtgggagagccagctgctccgctgagctgaccatccccctcaccgccccagcactcagttctccttgtttctttgtttcaggcrgaaggagtyccccgggcgtacacstacagcgcattcttctgtcccagtggtgagtcccccgtgcccattctgctaaggtgtggccacctggctgggtcaggactttggccttccccctttcccacactgtgggggctgtcccgctgcaaagtgagcacctgcccttcccctgggaagggggcactgtggtttaggaagaayratgtcccagctggggacaggcagagccagtgagggtggggcatgaatgaatgaatacacagggaatgaatactcrgggaatgaatacacagggaatacgcagggaatgaatacacaggaatgtgcactgcaggcaccaagcaagaaggttaggctgcccgggcacggtggctcacacctgtaatcccagcactttgggatcctgaggaaggtggatcatttgaagtcaggagtttgagaccagcctggccaacgtggtgaaacttatcaatactaaaagtacaaagttggccgggcgcggtaggctcacgcctataatcccagcactctgggaggccgaggcgggtggatcacaaggttaggagtttgagaccaagcctgaccaacatggtgaaaccccatctctactaaaaatacaaaaaattagctggtcgtggtggcacgcacctgtaatcccagctgctcaggaggctgaggcaggagaatcacttgaaccggggaggcggaggttgcagtgagccgagatcacgccattgcactccagcctgggtgacagagcgagactccaactcaaaaaaaaaaaaaaaaaaaagtatgaagttagccaggtgtggttgtgtgtgcctgtaatcccagctacttgggaggttgagacagcagaatctcttgaacccaagaggtggaggttgcagtgagccaagtttgcatcacagcactccagcctgggtgacagagtgagactccgtctcaaaacaacaacaacaacacatgaggctggacctaaagatcacaccttacacgagaatgaaccctaaatggatcatggacttaaacgtaaaaccatagtgcttttagaaaaaaacacaggacagcctgggcaacatggtgaaatcccatctctacaaaaaattaaacaaacaagcaaacaagcaaacaaaaacttagccagacgtggtggtgcacgcctgtagtcccagctacttgggaggtggaggtgggaggattgcttgagcccaggaggtggaggttgtagtgagcctttattgtaccactacactccagcctggttgacagagagaaaccctgtctcaaaaaaatgaagtaaggaagggagggagggatggagggagggaaggaagaaaggaaggaaggaggaaggaaggaaggaaggaaggaaggcaggagggaaggaaggaagggagaaaggaaagaggaagggaaggaaaggaaggaaaaaaggaaggaaggaaggaaggagaaagaaaagagggaaaaaaagatctgccacctagagccaagcatatagtttttagacttgaaaagtacaatctataaaaggaaacattaataaataaacctcttcaaactttaaaagtttttttctccacaataaaccctgttaagggaggaactacagtctacagactgggagaaaatacatttgcaaaccttatcaaattactggtttttagaatatataatgaagtctccaattcagtagtgaataaaacaaaccatctaattaaaagtgggcaaggccgactgtggtggctcacacctgtaatcccagcactttgggaggccgaggcaggtggatcacttgaggtcaagagttcgagaccagcctgaccagcacggtgaaactccatctctacaaaaaatacaaaaaaaaattagccaggcatggtggcaggtgcctgtggtcccagctacttaggaggctgaggcatgagaatagcttgaacctgggaggcagaggttgcagtgagccaagattgcgccactgcactccagcctgggtgacagaatgagactccatctcaacaacaacaacaaacaaacaaacaaaaaagtgggcaaaagaaataaccagacatttcaccagaggagacatacagatggcaaattgcacataaaaagatgctcaacrtcatttatcattagggaaatgcaaattacagcataatgacatacccctacacaccacctataagaatggctaagattaaaaatagagctgrgcgcagtggctcatgcctataatcccagcactttgagaggccaaggtgggtggagaacttgagtccaggagttcaagaccagcctggccaacatgatgagaccctgtctctacaaaaatacaaaatattagctgggcatggtggcttgtgcctgtagtcctagctacttgggaggctgaggagggaggattgcttgaccctgagaggctgaggtggcagtgaactgtgatggcaccaccacactccagcctaggcgacagagtgagttgctatctcaaaaaaaaaaaaaaatagtgaacactaaatgatggcaaagatgtggagaaagtggaccactcaaactttgctggtggaaatgtaaaatggtacagccacctttggtagtttttaaaaacagtttggtggtttcttaaaaaactgagcatgcaactaccccaccactcagtagttgtactcctgagtattgatctcagagaaacaaagacttatgttcacacaaaaacttgtacatagatgttcatattagctttatttgtagtagccccaaactggaaacagcccggatgtccttcagcaggtgaatgacttaacaaactgtgcattcaagccttggaatactactcattaataaaaaggacaaactattgatacataaaacaacttggatgaatcttgaatgaagggaattgagtgggaagaaaatcccaaaagatacatgaattattccatttatatttttgaaatgacaaaattttataaatggaggtcatattagtggttgccaggggttagggagagggagaaggaagtaggggatggatatggttataaatgggcaacggtgagaatctctgtggtgttgggaatgtttagtaccttgactgtggtagtggawtcgtgtacctacatatgtgataaaattacatggcactcacataaaaagtacaaatagaattggagaaagctgaataagattgatggattttatcaatgtcaatattcctgattgtgattttgcaagatgttaccatggggagagggggaaacgggtacagagagctctctgaattatttataacaattgcatgtgattatcttagcaaaactttaagttaaaaacatttttaaaagcaatacatatgtacaaataccatatgattccacttatatgaggcacttagagtagtcaaaatcatagagaaagaaagtagaatggtgtttacaagaggctgggggaggagggaatagggagcgagtgcttaatgtaataatgggtgcagagttacagttttacaggatgaaaagagttcttgaaatgggtgatggtggtggtggttgcacaacattgagtgtacttaatgccattgaactctaccctgaaaaatggttaagatggtacattttatgttatatatattttaccacaattaaaacattgtaaaatgaaaagcaatacatgtgtattgcagaaatttgggaaggtagaaggaaaagcatctcctctggttcacacccaaagaagacttcctttgacattttgttgtatttgctttcatagggttgattattgtttgttttaacatagttgttacttcacgcactatgtaattatatatgctgcatttttcacttaacacattctgagcactttttctggttagtataaagtctttatgaacagcatttcaagacagcctcagaatgtttcataataactgttccataatttaaccattatggagcattttagaacatgttatggaacattttggaacatattactggactttcttatagtacttctactttttaatattgtaattaacacttttatgaacatatttatatgaatagtaaaggcaataatattttaaatatgtttattgaggcataattgacatacaataaattacacacattttaaatgtgcaatttggtgagttttaacatatatgtacgtctgtgaaaccattgtcacaactaagataacaaacatttccttcacctcccaagagtcatgcccgtttgtaatctctcactcctgtttactccatcactagggaccactgagctgctttctgtctctgtagattagtttgtattttccagaatgttatataaatggaatcatgtcgtatgtattctttttgtctggtttctttcaggataataattttgagattcatccatggtgcatgtgtcaataattcaatcattttaaggctgagtaggattccattgaatggatatatcacaatgtattcatccattcatctgttgatgaactttcaagctgtttccagtttgggagtatctcaaataaagctactattatcatttgtgtcttttctgggtaacatgctttcctttctcttgggtcaatagctaggaatgaaagaacagaatcatatggttcgtgtatgtttaactttttaagaaactgccaacctgttttctaaagtgctcaggccattttgtattcccacctgcagtatgtgagagttccatttcctccccatcctcaccaacatttagtattgttagtctttttacttttagccattctaatagatacccagtgacatctccctgtggtttcagcttgcatttccatcatgactgatgatcttaagcatattttcatttgcctgtttgctatgagtatgtctttttttttgtggaaaaacgtctgttccaatcttttaacctgttcaaaattgagttgtactttttttattgcattttgagatttgaaaatatattctggatacaagttctttatcagataaatgctttgcaaaaatatttctcccagaccgtggcttaccttttcattcattctcttaattatatcttttgagaagcagaagtttttttatattaattaagtgcaatttattattttttctttttattcattaatgcatttgctatatttaagaaatctttgctaaaccctgttttttttttctcaaaattttgtagttttaagttttacactacaaagtggccatgattcattttgagttaattttggattaccatgcaagatatgcatcaaagtttatgtttctgcatttggatagccaactgtgccagcaccatttattgaaaagattatgttgcccaggctggtcttgaactcctggcctcaagtgatcttcctgcctcagcctcccaaaatgctgggattacaggtgtgagccactgtgccaagccctctcttgctgtctttagaactatctttttgtccaaccacactggaaaaaagggaaaagaaaaagtaaaagaaaaaaatgatatttttgtcttttgacagtttgaccataatgtgctgtggagaagacctttttgaattatacccatttggaggtgtctgagcttcctgtatctggatgcctaaatctcttattagacttgggaagttttcagctattattttgttaaataggttttctaccccttttgttttttcttcactttctgggacaccaaaattttgagtatttggttactttatagtgtcccatttgtcatgttggctttgttctttcttttatctttatttttgtctgattgggttattttaaaagatctgtcttcaagttctgaaattctttcttctacttcatctagtttattattgaagcttcctattttgtatttcatttaatgaattcttcagtttcagaatttgtttggttcctttttgaattgtttttctgacttctttgtatggttcttacgtgttctcttttgtctcactgagcttcttttatatcattaccattactatttcttgagacaggatctcactctgttgcccaggctggagtgcagtggcacaatcatggctcactgcagccttgacctcttgggcccaggtgatcctcccacctcagacccccaagaagctaggactacaagcacatgccaccacgcctggctaattttttgcatttttgttagagatggggtttcgccatgttgcccaggctggtcttgaatgcctggcctcacctgccttgaccctcaaagtattggaattagaggtgtgagccaccacactcagctaatgtcattattttgaattatttttccaaaattacatacatttttttttttactggaatcygttgctcaagaattattgtgtttctttggtgatgtcacgtttccttgctttttcacgtttcttgtgttcttacagtgatgtctatacgtttggtgtttggtgtaacagtcgcttcttccaatcttttgaatttgctttcatagaggaagactttttcctgaagatctatctgtggtgttggttgggtacagcatttagattgattctgaatgtgtayagtagtgtagtctccatatgatttctttagctataaacagcatcagtggtgtctgtgatttcctgagtggcttagggtgcagttattagtggaggctgtgatgaagttttgctggggatggggaagccagatggacctgtcctcaggtcccagtgttggcagcagtgggcaaagcatgacttccttgagcaccagggcattctacactggtaccagtgttagtgggtccaggtgggccaactcttggacttccaggaagctagcttgaatgccagtagtggcagcggtggaccaggaacatggataggttcttgagcccctgggcagtgggcttggcatgggcactggcagtagcagtggtgagatgaccctccggctcccaagcaatctgctctggtgttggtggtggctgtgacaggctgggtaggccaacctccttgcccacaggtggcataggcaggtgtgtgccagctgtggtgttagtggcacacattaggttgggtgagcctgacctcagatgcctaggaggagcgctcaggtgccggctgtggtgaactaggctgggagtctcaaggcccttggatggcaccctcaggcacttgcggggacagagctgggctgggccgacctatctcaggctccctggtggtgtgtgcagttgctggctatggtaggcaggggtggggtgattcttaggtctctggtggaatgctcgggttcagccttgctactggggagggtgcagttgcttccagtgacagcagccatatgcagtggctggggagcatgagctttgctcatgctttggcccctggctgcagcatcccatagcggcagttgctgcaggttggggagttagccctcggggcacgtgaaagtgtgcagcagcttcactgctgggggcagtgaggtcattgccaatggcttgggcttcattcctggtggcagcagccagccttggtggtggctgtgagcagggaatgtaagtggggctccagagatgtgaagatgcaggagctgtttggcccccaggcagaatgcagcctggcagtggctaggatctcgatayggtgccctgctgtagctgcttagggctcaagggtgtgtgagacccagccttagccccctctctggaacagtatctttgcacaatctctgggtatctccctaggctagtctgtggcccacgaggatctaggggctctcccatggctagagctgctagagtccacggtgggaatggggaccacgggggttcactcaccctttcctcacactggggagctactcccggcccccagctgattcccgccaagcaccatgtattatttccatttccttcttcgctttaggtgtttcttgtcacttctctgttgaattccagtgttcttagatgaactagtcaaagtgtgatgatctacttgttatttttgttcgtcaaggaggcaagtaccagatgcctctaagtagcccctctccccacataataattggtgcatttatgtttcctgatactcatatcacattgtggtgattcctgtcactttatggtaagtctcagtgtcagagagtgtgagttttccagttgtgttcttttttttttcttttttttttgagatggagtttcactcttgtcgccgatgctggagtgcagtggcacgatctcagctcactgaaacctccacctcctgrgttcaagtgattctcccrcctcagcctcctgagtagcygggattacaggcacytacccccacgcccgactaatttttgtctttttagtagagacggagtttcaccatgtgggtcaggytggtctcaaactcctgatctcaggtggtccacctgcctcagcctcccagagtgctgggttctttaccaaagttgagctctcctaggtcctttgcgtgtctgtataaattttggaatccagttagcaatttctccaaaagagcctcctgggattttgactgggattgctttgaatctgtagaaccatctggggaagaactctaatgttcatgatagtccatgaacatggtctagcttttgttgatttgggttttcttttgtttctctcttcagccttttgcaattttcaacaccttgctcatctttggtcagatttatccctgagcatcttatctttttgtttttagagagagaatcttgcttgttttttagagagagagtcacccaggctggaatgcaatggtgcaatcatggctcactgcagccttgaactcctgggctcaagcgatcctcctgccttggcctcccaagtagctggggcaacagatgcatgccactgttaacttaaaaacatttttgtagagataagagtcttgctatgttgcccaggctggtcttgaactcctggcctcaagtagtcttcctgcctcagcctcctaaagtgctgggattacaggtgtcagctactctgcccagtcccattttatcttttgtgtgccattgccaatgccattgttaggccaacaccattccaccatgtgtgccgagtcacagtgagacccactccttgtggtcctggtgctcacctccaggtaccatcagggaaagtgggatgcctccaggtgccctctcaactccccatctcctttcctccatccagagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggtatacagcagaactgcctggggcttgtgcagaagcctcatgttcctccaataytagctgcttcctgtttggtgccaggctttgatccrgggtcaggaggagcaagggaaacatggagcaccacctcaagttgttcttagtctagagtcgcttaccgaaaaaaaaaaaaaaacatgtagcaagagctgtggcagaggaagcacccaaggatcagggagcagagagaggaggtaggggagaaaagaagaatggacatgagcaagtgaaatgggggttggggggtgttttctgggccaaggaaaaagaagatatagaagctaacacagcttcccaacacaggaagctaatactgcttcctagaggaagaacataaccaaagtaggttttgaagtatgaataggagttcgctaggcaaaatggaagcagagtaggttctctaggcagagcaatagcatgtgcaaaggtccagaggttccaaggagcccaatgactttggaacctgtagatgccatgccttatgtttctgttggctgtttaatggatggggtaacctgatttctctcacctctgactccccgaagacccttccttgcactgtgagcatggctgaggcctctgaccctggccacaaagctggtgtcactgccacctgagtgcctactgcctgcttcctgccagygtccagcagccttggtttctttttccaggttggccatggtccagagccatccaatgagtctgtcattgtggcctggaccctcccgaggccaccagaggtccagttcattggcttttccaccggctggggctccatgggtgaattccraatctggaggaagatggaggtggacgagagctacagcgaggccttcaccctgggggtcccacacggcgccatccctgggtctgagcgagccaccgcctccatcatcggtgcgtctgtcccacagcctggcttggagaggtcagggggcaagagccgaagttgagactccaggcttagtctcaagctgggctttgctggggacctgtgtcttggggtgtccacccatacacccactcacctgacaagcagcttccagtgccttctctatgcccatccatgtgctgggcattgaggaagcccaagagctgatcccaaccccacccttgagggactcctagtccaggtgagatggcagatctagagccccccaagtctaaaccttatgcagaggtcagggtagggtgacccctaagaacctgcagtgaaccctgtgagggcagtgggccaaggacaagatccaagaaaacacaaatacctgaataagtcagccagatatgcggtgcaggatggaggcctggggggtcttggtgatggggcaggcgtccggagcagttgctgagtaggggtgagaggctctgactagggacattggaagcagccttagggggtctgtagggttgggatgtgtattagtctgttttcatgctgctgataaagacatacccaagactgggtaatttataaagaaaaagaggtttaattgactcacagtttcacgtggctggggaggcctcacaatcatggtggaaggcgacaggtacgtcttacrtggtcccagggagaatgagagaatgagagccaagtgaaaggggttttcgccttataaaaccatcagatctcgtaagacttattcactactgcgagaacagtatggggaagccgcccccataattcagttatctcccaccgagtccttcccacaacatgtgggaattatgggagctacaattcaagacaagatttggttggggacacrgccaatccatatcaggatgcctctagtagcccaggtgctggaggggctgtgattgatccagggctaggagttgggcagaagggtggtgagagtttgggatgggcctgagycagggaggagagggtgagaggccggaaggagatggacagacccaaatgagggtgtcgaggctctctctgacatcagagggtggaggccctgggactcaggcaggtaggtggttgtggccagatcagaggaatttcaagtttacaattcctgaggcacgagagcaagtcagagtggatgtggggctgagtgactaagatggaactgaatgagataggagaagaagcagagaggcaggaatggagaggaggcgacgtctgggatctgtgtgccagtgccttcagtgacacagcagatggagaaaaagctggggagcctagagcctagaaagtagccaggctatttgtgcaacaagagctgtaggggcaatggcagcctcagtgagacatgcagagaggctaaagaaagaaagaaggggccaggcgtggtggctcacgcctgtaatcccagcactttgggaggccgaggcaggtggataacgagatcaagagatggagatcatcctggccaacatggagaaagctcgtctcttctaaaaatacaaaaattagctgggcgtggtggcacaagcctgtaatcccagctacttgggaggctgaggcaggagaatcacttgaacctgggaggcagaggttgcagtgagccaagatcatgccactgcagtccagcctggtgacagagtgagattccatctaaaaataaataaaataaaataaaataaaataaagaaggaaagaaggtgtgttcaggggacattgggggtcccaggggggtccatcagaaatatttgagacaaggaagccaagaagaggaatacggaatgtcaaggggatgggagaaccataatttttttttaaagagagaaaactgaaaaatgcacctccaactccatacatatagaaactttttttaaaaattgaagtgctcttggttaaagagaaaatctgaatattttagaaagaatattttaggaccaggtgcagtggatcacgcctgtaattccggcactttgggaggcagaggcaggtggatcacgtgaggtcaggagttcaagaccagcctggccaacatgatgaaaccctgtctctactaaaaaaataaaaataaaaaattagttgggtgtggtggcacacgcctgtagtcccagctactcaggaggctgaggcaggagagttgcttgaacctgggaagcggaggttgcagtgaaccgagattgtgccactatactccagcctgggtgatggagtgagactccatctcaaaaaaaaaaaatattttagaaagactagaatagaatgagaatgattgtatagacataccaatatttgtaggatgcaaccaaagttgtacttagaggccaatgtatagctttcaatgcacctattttaaaagccagggagggaaaaagcattgaacagaatgaaaagctagagaaagaaagcctgagttaaaactaaagaacacagaaggaggtgtgtaaaactgtcaccaaagccaggacaccagctggtctgagcaggcagagggtgccagtcccaaagggcagttgggtggctgactgcatgacactcactgtctcccatccctggktaaagctgtccctgttctctactgaactgggacagcccccaactcaactctcttcwccttcccaccaggggacgtcatggggccaaccctgaaccacctcaacaacctcctgcggctgccgtttggctgtggagagcagaacatgatccactttgcacccaacrtctttgtcttgaagtatcttcagaaaacccagcagctcagccctgaggtggagagagagaccaccgactacctagtacaaggtattggggaagaagtgcctgggttgaggtgggagcaagggaggcaggttcagccttcagtggagaagaccaygctggaggtggcccacacaccaggtgcagcaaagkggaggaagtgggcaaaagaggccattcagggtggccctgatcttgtcactgtcagcaggagcctgatgtctgtggctgttaggatgagatggtgctgttcagatacagggagaggaaaagcatctttttaaagtgtggatttttttacaacaataataatataacagcattattaaaaataacatttagaaaataaaagagaaggccaggcacagtggctgatgcctgtaatcccaacactttgggaggccgaggcaggaggattacttgagcccaggagtttgagacaagcctgggcaacaaagcaagaccccggtctctacaaaaaataaaaaaaatgttagccagacatggtggcacacccctgtagtcccagctgctcaggaggctgaggcaggaggatcacttgggcccaggagttggaggctgcagtgaactgtgattgtgccactgcactccagccagggtgacagagtgagaccccaactgtaaaaaataaaaaagaataaagaagaagaaacagtcaggggttgctctaggctgaaagtctggcatcttgaaggctgatcatggacagctaggaaggccaagtccactgaggccaggtcctgggggctcagattagcacttgtgagggtctgggagatgggtggacaccagctggtggatccatccaggctcaggtccttaaacaccacccagagttgaatgagccctcctcgtgaataacagcctgtacctccaggggacagccggaccctgtgtgcatccagccaactcgcagttcagactcaacaaaccccaaatcaacccccgccatcttccccccaaacccacttgtgttcatttcctaaaactgccacracaaaatgccacaaaccgggtggcttagaacgacagaaatgtgtcatctcctcatagttctggaggccaaaagtcaaaaataaaggtgtccgcagagctggttcctactggtggctctgagggagactgtcccaggcctctctcctggcgtctgctggctccaggagttccttggcttatagactgatcagcctgctctgtgccttcacaatcacatggctgtcacctctgtgactaattccctttcttttcttttttttttttgtaagagctagggtctcgctctgtcacccaggccggagtgcaatggtgcgatcatagctcactgcagacttgaactcctgggctcaagtgagcctcccacctcagcctcctgagtagctgggactacaggtgtgcaccaccatgcccagccaattctttgtaaagatggggttccgctatgttgtccaggctggtcttgaactcccggcctcaagtgatcctctcaccttggcctcccaaagtgctgggattccaggtgcaagccacgatgcccggcctctcttttctcttacaaggatgcctgtcattggatttagggcccatcctaaataaatccaagatgctctcatctggagatcctaaccttaatgacatctgtaaagatcttttatttccagtaaggtcccatttttgggttccaagtggatgtgaatttgggaggacccacccagtacagaatttctttggtcaccggtcctgtctctgtggacacagccctgtccttcctgargctcagaccacacacagtggtgccctcagattcgtccttctttccctcacaggctgtgtctggctgagtagctctgccttcaccccaggaaggctccccacctctgtcgccgccactgggtccaaactcatcattgcacactgggagggttccccgtccccagctttctgtccagaccctacggtccactggctctatatgtctcctcacactcttctcctactcacacgccacccatggctccctatgcccttgcaggaaaaccacactcccagcccagccttggaggccctgtggcccaccggcctctcacctcaccccctcgttccctgctccgttccctgtccccggcaccaccagttctctgagcttcccaagctctcgccccagcagttggagcagcccccacgcctggggacagagggctgtgggggacagagggcgctgccccaagatggtggttttgctgacctcctgggagtgaccgaaggccagtgtgtgaccagtagtcacgaaggggcaatgtcagtaaacaagatgaatgagttggaggttacagccaccctagatgtagtgtggggcagtttcaaggacctcagatgtggtgtgaggtagttccagggatccccgatgtgatgtggagcagtttcagggacccccaatgtggtatagggtagtttcaaggaccccagatgtggtgtggagcagtttcaggaaccccagatgtgtggagcagtttcagagaccccagatgtggtgtggggcagttccagggacctcagatgtagtgtggagcagttccagggactccacatgtggtatgaggcagtttcaagaactctagatgtgatgtggagcagtttcggggaccccagatgtgctgtgggtrtggggcagtttcaagaaccccagatgtggtgtggagcagtttcagggaccccagatgtagtgtggggcagtttcagggaccccaggtgtggtgtggagcagttccagggactccagatgtggaatgagacagtttcaagaaccctagatgtgatgtggggcagtttcagggaccccagatgtggtgcgctgcggttccagggactccagatgtagtatgaggcagtttcaagaaccccagatgtggtgtggggcagtttcagggaccccagatgtgacacagggcagtttcagtgagcccagatgtggtgtggagcagttttagggactccaaatgtggtataaagcagtttcaagaaccccacatgtggtatggggcagtttcagggaccccagatgtgggtgtatggcagtttcaaggactccagatgtgattcgaggcaattccagggaccccacatgtggtgtggcttcggagatccggggtaggggacggcagagtggtgtaggtccctgggggcgggcctgggccaggccactcaacaggacagggtcctctctgcttgccccacaggctaccagcgccagctgacctacaagcgccaggatggctcctacagcgcgtttggggagcgggacgcatcggggagcatgtggtgagtccccaccgccctgggcattgcctctgaggctccccgcccgacgccatggcctcacatccaatgcagtgtgaccagatcacttggcgcctgatccccggatgacagggaacacagctgggaagtaaagactgtggtggtcccagctccagrgatggaggytggggcttggggccagtgcagagctggtgatcgtaaccattcctgtttctgctgctgttaccacagtgagcaagactccatgccctgctctctggccccttgggagtgagccctggatgccctgggcttcctcaagctcccaggactcaggaatagcggtgactggagcaggaggagatggcagggcagaggggtcagaggccagaccagcaccttgaggctggggtgtgctgtstgcaggagcagcctgggatcttgtttctgtggtaactgcagggaggwgaccagggcagggagggcccctgggaggccgggcacacctgggtcttgttttcctgatatcctcaggctattgcagttcttggcatcatcatggggttcacctgagactgtgagtcactttccaactcctgtacccatcgccggactccttctcggagattgccaccctggtagtgccgacagcagctgtgagcgtggaaactgccctgtctttagtccaacagagtgtccactgcacagtcacagtgccaggatcccagggagtggggacatgtggctgagtacttcctgccatgggcagcatcacttacctagctccagaggggcccagggttggcgactcacccagcctcccccagccccaggagctcatccacactgtcccagctctagtcccagggccctgccttgcckacagctgataacrcaaggccccaatcacrtcttagcaagcagaggccccgcccaccccagggacagctaaagccactgagtcactctccaaaagctggctgagccccagcagcccctaggaggcctccaccagccaggattagcaagttgtgacgcattggaccttttttttttttttttttttttttgagatagagtctaactctgttccccaggctggagtgcagtggtgcaatcttgggtcactgcaacctccatctcctaggttcaagcaattctcctgcctcagcctcctgagtagctaggattacaggtgtgcaccaycatgcccagctaatttttgtatttttagtagggacggggtttcaccatgttggccaggctggtctcaaactcctgacctcagatgatccgcctgccttggcctcctaaagtgctgggattacaggcrtgagccaccgtgcccrgcctagacactcagtgtgcacacacctcctcagcatcttccggggattaaactctcagcatgagcaagaaaaatcaaatttcctttttgttttttttgagacggagtctcgctctgtcacccaggctggagtgcagtggcgccatctcggcacactgcaagctccgccccctgggttcacgccattctcctgcctcagcctcccgagtagctgggaatacaggcgcccgccaccacgcctggctactttttttgtatttttaatagagacggggtttcaccgtgttagccaggatggtctcgatcttctgaccttgtgatccgcccgcctcggcctcccaaagtgctgggattacaggcgtgagccaccgcgcatggctgaaaaatcaaatttcactgtgtgcatggaagtcagcagcttccaggtcccctctcacctcctgaaacattcctgttggtctccaaacatggacgtcttcctggggaccctgtaggacaaggaggcagtgagcgcagggcagtggcagcagcacccaccccgaagctggacaaacctcagctctgtctcatgtgagctgtgtggccttagacccratgatcaacctctctgagcctgtttccttaccacacatccctctaagaacctggatccatgggataagcatgtggtacactcagtgcagtgccgtcctgttagcacctcccctaactacttaccakaaggctccaagatcctgccagggagcctgaaaacttgggatctgttctagatgggttcccttatactcaacgcayattcattcatttattcattgagtgagctaggctctggtcttcatcctgggggaaaaaggaacacatggttcctacctccaggtcctygctgcccagtgcaggagaaagaccctgtgagagatgcaatagttatccactgctgtgtaacaagtgaccccaaatgtagccatttaaaacaacaaacgtattatctctatttattatgtattaattcttatggatcaggaattcaggagcagcttagctgggtgtttctgcctggggatctttgctgaggttgcagtcaaggtgttggctgttgctgtcttcatctgaaggctctactggggctggaagatttgtttccaaattggctccctcacatggctgttggcaggaggcctcagttgctcaccacatggacttctccatagggactacttgagtgttcttacaacatggcggctggcttcctctcacagtgagcaattcaagagagaaagcgggaaggatgccatagcgccttttgttacttggtcttacaagtcaggctgttacttctgcctcattmtattctattccttttttttttctttttttgagatggggtctcaccctatcacccaagctggagttcagtggtataatctcggctcactgcaacctccacctcctgggttcaagcaattctcctgcctcagcctcctgagtagctgggactataggcacctgccaccatgcctggctaatttttgtatttttaatagagacaggatttcaccatgttgcccaggctggtctcgaattcctgacctcaggtgatctgcccacctcagcctcccaaagtgctgagattacaggtgtgagccaccgtgcctgggctccaagatgcttttagtgccaacctcatgctcaagggaaatgttcattggagcatttcagattttttgcatttgggatgcccaagtatacaggtagccctccgtatctgtgagttccacaggattcaatcaactacagatcgaaactattcagaaaaaaaaaaaaaaaaagtctgggtgtgatggcacgtgcctgtcatccctgcactttggggaagctgaatcgggaagattgtttgaggccaggagtcggagaccagcctgagaaacatggcaagacctcatctcggcaaaaatgttaaaaataagctgggygtggtggtacatgccttagtcccaactactggggaggctgaggtgggaggatcccttgagcccagaagttcaaggctgcagtgagctatgattgtgccactgcactccagcctgggtgacagagcaaaactccatctcttwaaaaaaaaaaaaaaaaattttaaaaattccacaaagttcaaaaacgaaaagttgaatttgctgcatgctgagtacaatattgaattcatgcaaatgaagtgacatgtgggcattgtattaggtgttctaagtaatcaagacatgctttaaagtacacaggaggggccgggcgctgtggctcacgcttggaatcccagcactttgggaggccaaggtaggcggatcacctgaggtcaggagttcgagaccagcctggccaacatggcgaaaccccgtctctactcaaaatactaaaattagctgggcatggtggtgggcgtctgtagtcccagctactcgggaggctgaggcaggagaattgcttgaacctggaggcagagattgcagtgagccgagattgtgccactgcactccagcctgggcaacagggtgagactgtgtctcaaaaataaaaataaaaaataaagttcacgggaggatatgtgtcggttatatgcaactactacacactcgtatatcggggacttgagcatcagtggatttcggtatccttgggggtcctggaaccagtcccctacagataccaagagattcccgtaaatgcaaatattccaaaatccaaattcaaaatctgaaacacttctggttccaagcatttcagataacagatagtcattagactttactttttattatttattttaactaattttttttgagacaagatctcgctctgtttcccaggctagagtgcggtggcacaatcagggctcacagcagccttgattttctgggctcaagcaatttttccgcctcagccccgcaagcagctgggaccacaggcatgcactaccatgcccagctaatttttttgaatttcagtagagaccaggtgttgctgtgttgcccaggctggtctcaagctcctggcctcagccgatcctccacctctgcctcccaaacactgctggcatgagccacctcgccyggccatagatcttactttttagaagagttctaggtttccagaaaaattgagtaaatagaacagagttcccatwcacctctacacccccatacacagcttcccatgtgataggcatcttgtattagtgtgctgtatttgttacaattgatggaccggcatcaaaacgttatgaactaaggttcataatctacattagagttcactcacacactcattttttatttatttgtgtgtttgtttatgaataacagggtctcactatgttgcccaggctggtttcaaactcctggcctcaactgatcctcctgcctcagcctcccaaggtgttaggattacaagtatgggccactgaatccggctgagagctcatttctttttatcacttgataacatttatcctgtttgcgttttacagtgggaaagtagagagcacagtatgctagaccatgggaattccacaattcccagcacacagctggcttggttctgtccttgcctcctttccctgccgtgcccaaaatgcatggagtttccccctggttgcagtgtgcatagctggtaatggggtggggatgagcctgggagccatggggtctcctggctaatccagggaacatgggaatagaaagaagaggatgcatttgaggtacctgagagggagaacggcctggacgagctttgggtatattttattttattttatctatttatttatttattcttttttgtctgagacagggtctcattttgacacccaggctagagtgcagtggtgcgatctcaggtcactgcaacctccgcctcctgaggtcaagcaattctcttgcctcagcctcccgagtagctgggattacaggtgcccgccaccacgcctggctaatttttttttatttttagtggagatggggtttcgcatgtcagtcaggctggtcttgaactcctgaatcccagcactttgggaagccaaggtgggaggatcacttgaggtcaggagtttgagatcagtctggccagcatggtgaaaccccgtctctactaaaaatacaaaaatattagctgggcatggtggcaatcccagctactcgggaggctgtaatcccagctactcaggaggctgaggcacgagaattgcttgaccctgagaggcagaggctgcagtgagcatggtggcttatgcctataatcccaccactttgggaggccattgtgggaggatcrctggagcccaggagttcgagacctgcctgggcaacatagtaagacctcatctctataaagaatttaaaaattcgctggatgtcgtggcacgtccctgtagtcccagctacttgggaggctkaagtgggagaatcgcttgagctgggagttgtaggctacagtgagttaggactgcaccactgcactccagcctgggtgacagagcaagaccctgtcttgaaaagcaagaaagcaagagagagagagagaggaagggagggagggagagagagagaagaaagaaaatcaagaaagaaaagtaggaaagaaaagagagagagaaaaaggaaggagagagagaaagagaaagaaagaaagaaaaagaaagaaaagagagaaagaagaaaggaagagggagggagggaaggaaggaaggaaggmggcaggcaggcgggcaggcgggcaggctaatgcatcccatttttgtggttcatataaagagcctagagccacttgattttgaagacagcttattcattgatcctgaatttgcgaagtttcctctcctgacaattttggttttcatccctcatggcctcctggcttccatcctgtgcttctctccttcatttrttcatgcattcattccctggccttgccagctcttactcagggtggcacctgcaaaagcagggcaagggagatggggtggatgagggacaggccacataacagagatgtttttggctgaaaacaacagaaaacgggctggagagcaattctgaacatcagctcacactgcagggctggggaggtgctatggttggctaattcagcagccccatagtgcactggggctcgtttttttccttccatccctgggtattccctcccttggcacatggctgcacccctcatggtggcaaaatggctgcagctgctcccagcattgcatcacatgcccattccaaagccattcccaggctcagaaactggaatgcccatgactggctggctgggaccacagagaagcacagatctccagggcacatggctgctggcccctgaatgagatcaggggccttttggcaaggaccaagcaagaaatggctgtgaggtcggcaaccagaagggtcttcctcacatggcaggacaggcagggctagaccagctcacagaagggccttgagtgccgagcaaggagcagacctgaatgccactagggtagaggtccaggtaggaaggagagagctccgtcttcaagccccactgggtgctgggcaatgtgccccctcctccactctgacagccctgtggggacagatgggacccctcccatcttatagatgaggaaatggaggccgggggtggtgccaggagcttgctgcaatccctcagccagcatgtgggggctgaccattctgcaacccctcagctgacaccctgtcctctttcaggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccaggtgagtggccccttgagcctccttcccgggcccctcacctcctcccagagccccagccctgacctgcctgttcctactccctggagctgcctgggggaagtggggggaagtggactgtctcctttggcttagggtgaggcctgtgagtccccttgyagggtgggatccacggcaytgtcccgctgacagcctacgtggtggttgctctcctggaaacaggcacagcctcagaggtgagtacagaaggggtttggggagactcggggctgggcactggaggagcaaatggaaggttccctcctttatgccaggggtgatttcttcctccctgccctccttctgctcattatcgaggctttttcatgcttttcatcaacaatggtcacattacatccagtttcttgtaatctgagcagaggagagagagattcccatgctactagggggaaattgggcacatgttgggggctggggaggtgccctgagtacagagcctcccatgactgtccacagcccctagacctccttcagagaatcatttcaggctagttcaggttcctggccagtgacccaagggttggcttcagggaaccctacaaaatgttgggctcatgcatgtttttgcagggaaaggggttaggatattcagagacagttggtactggatggggcttagatggcccaagagacttgagggccatagtctcttctatgaggctttcctggggtgggggatggcacagtctctgcagagaaggcttccacgatggatctcagccctgggtgagaagaatmtgccctccctaatacctacatcaattctacaatctctcatgataaattatgagtttgggcacttctcaggattcttggtctcacaatccagacaactagtgggtctacagtttgctgtgacctaagaccgcccccaccrtgcacaatgtccagagggccccttgccttgtgttatgggctgaattggttctcccctgaccaaattcttatgctgaattcctaatgccctgtcttagcttgggctgcagaaacaaaataccatggagtaagtggcttcaacaataggcatttattttgcacagttctagaggatgggaagtccaagaccaaggcacaggcagatttggttcttggtgagggctctcttcctgatttgttgactgccaccttctcactgtatgttcacatggcgtttccctagtgtgtgcatgtggagagagagctctagtgctcttcctcttcatataaggacactaatcctattattttggaggccccatcctcgtgacctcagtctaaacctaattatctctcaaaggtccccaactcctaataccatcatattaggagttagagcttcaacatatggattctgaggaagatcacacgtattccatgacaccccctcatacctcagaagtcctcctccacatctcccatggaagtggtcaaatatgtcacctcccaaatgcatttttctggaaacttccctgccagagcccttggcccccactcgagttggaatggacagcacccaggatgctgcacaattgctaccctcctttactgagaaagggttttgggaggcacattttttgagacgttgcatgtytgcaaatattcttattctggccctgtatgatagctgggctgggtatagaattccaggttggaaattgttttcctgtagaataattgatgatgttctatcatcttctagtttcctgtgttccactgagaagtcggatgtcattctgagtactatcctttgtatctcgtttgttctctcctctggaagctttccaatcttctcattgtccatatcactatggacaacaagatatgtacacttttatgacacatatcttgaggtgagacttttttttttcagctcactgcaacctccgcctcctgggttcaagtgattctctttggcttggggtgagggctgtgagtccccttgcagggtgggatccatggcatggcagcttcagactcccgagtagctgggactacaggcatgtgccactgcatccggctaattttcgtatttttagtagagaccaggttccaccatgttggccaggctggtctcaaactcctgacctcaggtgatcctcctgccttggcctcccaaagtactgggattacaggcataagccaccatgcctggccctcccttatgtcttcagtgaacactcaacaggccctctacctccttcctatcccttgaggtcacttcacttctcccaagaatctttttctgccttctccatagccttccaacctatttctcttctgaacctgaaggcctgccctgcagggcagcagttgtttctccctggtcttctgagttctggtctcttagatcagcagtatccaacctttttggcacaagggaccagttttgtggaagacaattgttccatggactggggaagagggggtagttttgggagattcaagagcattacatttattgtgcactttatttctattattattacattataatatataatgaaataattatacaactcaccataatatagaatcagtgggagcctgagcttgttttcctgcaactagactgtcctttctgggagtgatgggagacagtgacagatcattaggctttagattctcataaggagtgtgcaaccagctgggtgcagtggttcacacctgtaatctcagcactttgggaggccaaggcaggcagatcacttgaagtcaggagtttgagaccagcctggccaacatgatgaaaccctgtctctactaaaaatacaaaaactgtctgggtgtggtggctcacgcctgtaatcccagcactttgggaggctgaggcggtggatcacaaggtcaggagatcgagaccatcctggctaatctggtgaaaccccgtctctactaaaaatacaaaaaattagccgggcatggtggcaggcgcctgtagtcccagctactcgggaggctgaggcaggagaatggcgtgaacctgggaggcagagcttgccgtgagccgagatggtgccactgcactccagcccgggcaagagtgccagactctgtctcaaaaaataaaataaaataaaaataaaaatmcaaaaattagcttgtgtggtggcgcatgcctgaagtcccagctacttgggaggctgaggcaggagaatcgcttgaacctgggaggcagaggttgcagtgagccaagctcgtgccactgcactccagcctgggcaaccaagccagactctgtctcaaaaaaaaaaaaagaacaaaaaaaaaaggagtctgccagcaaatgcctcacatgctcacagttcacaatagggttcatgctcccacgagaatctaatgctgctgatggtccgatgggaggtggagctcaggtggtaatacaagcgatagggagtggctgtaaatacagatgaagctttgctggctcacctgtcactcacctcctgctgtgcagccccttcctaacaggccaccaaccggtaccagtctgtgacccggaggttggggacccctgtcttagatcgttccccaaaggaggcaaaacctgctgtcttcatttcctgtggctgccataacaaattgccacaaactgggtggcttaaaacaacagaaatacattctcattgctttggagaccagaagtgcaaaatcaaggcattggcaggcccttgctccctctgcaggctctaagggaagagctttctttgctgcctccagcttccagggaccccaggcattctttggcttgtggctgcatcactctagcccctgcctttgtctgcgtgtgaccttctcctctgtcttctccccttctcgtctcttaaacaacacttgttgccatgtgcagcagggcattcctgtagtcccagctactcgggaggctgaggcaggaggattgcttgacccaggagttctgggctgtagtgcactgcaccaatcaagtgtctgcactaagttcagcatcaatatggtgacctcttgagagcaggatgaccaagttgtccaaagagggatgaactggcccaggtcagaaatggagcaggtcaaaactcctgtgctgatcagtagggagatcgtgcgtatgaatagccactgcactccagcctgggcaacatagtgagacctgtcactaatttaaaaaaaaaaaaaaaggcgggcccagtggctcctgcctgtaatcccagctctttgggaggctgaggcgggcagatcacctgaggttgggagttcgagaccagcctgaccaacatggagaatccccgtctctactgaaaatacaaaaattagctgggtgtgatggcgcatgcctgtaatcccagctactcgggaggctgaggcagaagaatcgcttgaacctgggaggyggagattgcggtgagctgagatcacgccattgcactccagcatgggcaacaagagtgaaactccatctcaaaaaaaaaaaaagttaaaggttcttgtcattggacgccaagcacagtggctcatgcctataatctcagcactttgggaggctgaggcaggtggatcacatgggtccaggagtccgagaccagcctggccaatatggcaaaagcttatctctactaaaagtacaaaaatcagccaggcaccatggcacgtgcctgtaatcccagctactcgggaggctgaggcaggagaatcgcttgaacctggaaggtggaggttgcagtgagttaagattrcaccaytgcactccagcctgggtgacagtatgagaytgttttaaaaacaaacaaaaactcccgtgccgatcagcagtgggattgtgcctatgaatagccactacactccagcctgagtaacactgagtaacagtgaaacctctgtctctaatacaaattttttttttttgagacgaagtttcgctcttattgcctaggctggagtgcaatggagcgatctcagttcactgcaacctctgcctcccgggttcaaggattctcctgcctcagcctcccaagtagctgggattacaggcatgggccaccatgcctggctatttttgtatttttagtagagatgggtttgtttgtttgtttgttttccctttttgagatggagtctcgctctgttgcccaggctggagtacagtggcgcgatctcggctcattgcaagctccgcctcccaggttcatgccattcttccacctcagcctyctgagtagctggatctacaggcgctcgccaccacgcccagctaattttttgtatttttagtagagatggggtttcaccatgttagccaggatggtctcgatctcctgatctcatgatccacctgcctcggcctcacaaagtgctgggattacaggcgtgagccaccgtgcccagccaaaaaaaattttttaaagatatttgtcattggatttgaggccaccttaatccaaggtgatctcatctcaagactcttaattacatctgcaaagacccatttcctaaataagtcagcatttacaggtcccagggaatatatctttttggtgggccaccgttcaaccygctacacctgtgctggaatcagatgagctggggggcaaccagcaaatgaccttgaccccttggagttccgttgcatccgcttgtctgtaaacgggaggatctgcacagctggggccrggctgggtccatccctgcttggtgtggtctccgcagcgtccttgagacccgtcctggcccgcgtgacctggggtaactcccatgtcactgttcctgcccctgggatggggatgtccaaccttcccccacccccaggcaatggacttgtgagggccagtcctagggtctggctagtcagccgggttcatccctggcacatgcctcccaaagggcatctcaatgtcacaccttagggacagttcccacgtttgtcctggtctaaggatggaaagctttggaaacattctttctatgaccaggacagttccgaaagcagagttagctcaactccatacctctattgggccaccagaagactctggttccattgctaaatttgttaatgcttctggtcactcatttcttccacataatattattgggcagcttctctgaaccaaaaccatcagtagattctggacttggtccctgtcttccaacagatcacattctagggagggcatgagcagggctggtgggcttctctaaggaggtgaccaggcctggaggctggggagggcctgggctgtggaggtcttaggagccagctttttatttctattatttttttttttttaagatgaggtctcactctgttgcccaggctggagtgcggtggtgcaatctcggctcactgcaacctctgcctctcgggttcaagggattcttgtgcctgcctcagccttctgaatagcttggattataggcgcccaccaccacgcctggctaatttttgtatttttaatagagatggaatttcaccatgttggccaggctggtcttgaactcctgacctcaagtgatctgcccacctcggcctcccaaagtgctgggattacaggcatgagccactgtacctggccttagctagctgtcttaacaaagacctggccatggrgctgggtgggacagggtggccaggactctgcctgcttcccctagagtatcactgtgctcatttgccatgcacttgggcatcctggccagacctcatttggaaaaaggagtgccaacttacaagaatggtaatgggagccaggggcagtggctcactcctgtaatcccagctctttgggaagccaaggtgggaggctcgcttgagcccaagaatgtgtgaccagcctgggcaacatagtgagactccatctctacaaaaaataaaatgttagctgggcgtgctggtgtgcacctgtagtcccagttactggggaggtcaaggcgggaggatcgcttaagcccaggaagtgaaggtttcagtgagctatgatcgtgccactgcactccagcctgggcaacagagtaagatgctgtctgtattttttttttttttttttgagacggagcctcactctgttgccaggctggagtgcagtggcgcgatattggctcactgcaacctccaactccctggttcaagcagttctcctacctcagcctcccaagtagctgggattaaaggcatgtgccaccatgcccagctaatttttgtatttttagtagagatggggtttcaccatgttggccagggtggtctcaaactcctgacctcaggtgatccacccaccttggcctcccaaagtgctgggattacattgcgcccagcctattaccaaaaaaaaaaaaaaaaaaaaaaaggcaagaaagaaaagaaaggagatggggtttgaaaattgggtctgcaggcagtgagagccacagaaggatgcaaagcaaggggctaggagtcacccagagctctcctcggggatgcctcagaagccagtgggtgggtgggatgggggcagagcagcctcccaggtttcaccttcccaccccaccctgcaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgaggtaggtgtccctggccctccccagaggccacagcgtcgggaagcccactgtggagtctggtaaacaactcatgaacatatttatcacaactgacgagtcatgtagtcccagctactcaggaggctgaggcaggagaatcgcttgaacccgggaggcggagattgcagtgagcagagatcgcgccattgcactccagcctgggtaacagagcaagactccgtctcaaaaacaaaacaaaacaaaacaaaaaactgatgagtcgaccaggcgcggtggctcacgcctgtaattccagcactttgggcagatcacttgaggccaggagttcgagaccagccgggccaayatggtgaaaccccgtctctcctaaaaatacaaaaattagctgggtgtggtggcaggtgcctataaccccagctactcgggaggctgaggcacaagaatcacttgaacccaggaggcagaggttgcagtgagctgagataatgccattagaaagaaagagaaagaaaagaaggaaggaaggaaggaaggaaggaaggaaagaaagaaagaaagaaagaaagaaagaaagaaagaaagaaagaaagaaagaaagaaagaaagaaagaaagggaaagaaggaaggaaggagggagagaagagagagagggagggagggagggagaggaagaaaggaaggaaggaaggagaaagggaaactgacgagatgccttttgcttgtcaattgctttgttgattatagtattcattcattatcgcatctgctagtgactttatttgaggaagtggcttgtccaagtcacaccagccccaagcatcactttccttgcctgtgaaatctgggatgccaacccctctggaaggggagttctcagagagggatccccagcagagaacgcatcccccgcctccggccaggcttcctggaaatcatcccaggacaggggtgctgggagacaggggagggttgggtctcgcttccacccttccctccacttgctgagtgagccctggaaagcttttttgagctgtcagtctccccacctacaaaatcatcaccccactgggactccaatccctgagctttgactttctcagaatgcccccaaacttagtctcctcctacttcacccagacctccccactccacccctacccccagcagctgcactggggctcagacaggtttctctgcttaagcattaagatgccacctgaagaattgttttcattgcttccgaaagaaaaaagtttaaagaggatccagggatggagtgggaggtggtggtggtgggctggtttctctctggatttgagagtctttacacctcatgcgagctcagaatccttggagcctttttctttttttttttttttttcttttcttcctttttttttttttttttttgaaacggagtttcgctcttgttgcccaggctggagtgcaatggcgtgatctcctaactcagcctcccaagtagccaggattacaggcatgcaccaccatgcccagctaattttttgtattttttagtagagatgagtttctccatgttagtcaggctggtctcgaactcctgacctcaggtgatccgcctgcctcagcctcccaaagtgctgggattacaggcrtgagccaccgtgccttgccattctttttaaattattattattatttttatttatgtatttatttatttattgagacagtctcactctgtcacccaggctggagtgtggagtgcagtggctcggtattggctcactgcaacctctgccttctgggttcaagcaattctcctgcctcagcctcctgagtagctaggattacaggtgtgcaccaccacacacagctaatttttgtatttttagtagagatgggatttcaccatgttggccaggctggtcttgaactcctgacctcaaatgagccactcacctcagcctcccaaagtgctyggattacaggcgtgagccactgtgcctggccagaatctttgagcctttgcaagtcgagtgtggctgcttgggcactaagtaggaacatcaggggctggatcagtacctggtcagragggaggctattgactagtgatgtctgtgtccaggaaggggaaggtggcctttgattagtgatgtctgccaggggtarggttgggtagccattgattcacgatgtctgccaggggcacaggaagggctggggctgccataggtttgcagatctgagatggagccccaaggcccttcctgttccagctgtcttcccctgatactcttctcccactggggtcccacaataccttttctttagaccccatgcttggatgygctccatsggatgccaggctacacactgggtgggttatagctcttgaccactcctttccttgcagatggggtcacccactggagcctgtcaaattcctgggacgtggacaagggcacattcttgagcttcagtgacagggtctctcagtcaggtactggccaccccagctcccgggtgcctgccttggccatacctccatgcactgggtccatgtccctgtgtcaaaagtccccagtgggcctcttccattgcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggcgagccgggcagggccagagggaggggctcagggctgggtgggtggggtccctgcagtccttgttttgagctctgaggtggccaggcagtctggccccttctcaccttatggagccccaaagagggcaggggttgggggtgagggacagatgcccctggatccyccatgggagcccagcctctgcctctggggacacaccaacctggctgtcctgaggcccccagtgccatgggtgtctgcactgggtccagtctctattccagccccgttggtgcctgttttaggctaggcttccaagacggggttcaggggaccactggccaactcagtctcagggttgatggccgtctcctcctccatccccaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcggtgcgtgttcctgggatgagggtttgggggtkgttggaggaggggtcagcagggcctcacggtgacttctgtctccagatccccagcctccccacggggctgtttgtgagtgccaagggggacggctgctgcctgatgcaggtgaggttttggggagcacgaggtgatcttgggcttgtcctcctgtgccccattccctccaatcacacagtggaaccccagggacccccagagggttctgaactcagcagcatgccagactgcaggacaggttttcagccttctaatactgcccaaggcaggtggccatgggtcctctcaggtgtgccacccccacacctgagagggtccatttgaccctcagtccagggatctctgacccattgactcaagcagatttgcctaagggctcgaggtcattccccctgctgtggcctggatttagccccagaccaggctggggcaggtgcatgtcacgggttctgactggcagtcagagggcaagtttcccgcgatgactctcgctagcctccgttttctgatctctaaaatgggagctcagataacactgtggatgagagggagacccctaractcagacatagctgagcacagctctgcaccccagatccataaaactggtctgatgattgtacctacacccgcttcagtgatttcaaggctaaaacgaataacggtagtctctaaaactgtcatggatgtcattgtcctcataattctggctgttcccacctccccactgcccttctcctcccctaccctgcacctgttatggagggcccaggtccctaagcctccatcctccaacaccccccagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtaaggccacctgccctgctggcgtgggcatcccaggagggtgcaatgtgcggagaggatggcctcctgggaccaggaggagcttccggctccaggcactcagtggtggtttttgttttgttttgtttttttgagacagagtctcaccctgtcgcccaggctggagtgcaatggtgcgatctcggctcactgcaacctctgcctcctgggttcaaatggttctcctgtctcagcctcccgagtagctgggactacaggtgcccgccatcatgcccaactaacttttttgtctttttagtagatacagggtttcaccatgttggccaggctggtctcgaactcctgacctcgtgatctgcccgcctcagccccccaaagtgctgggattacaggtgtgagccacctcgcccagccagtttttgaaatgaatgaaagaaaagcaaatggacacagaagactccagtatggtcggggcgggtgggctggatggggacagcgatgtgtggctgggacactggtccctgcccgataacaccagcaccagaccccttggtttccaagagtgagcctgggacccggccgcagcgggccctcaccctaagaagatgtttgttgccatggtgatggatgcttgtcaccatggcgacgattggtgggtgagtggttgccatgacactcgcagcccatcagagccgctaccccggtaacggctgccctgaccttgactctcagcccgaatgtgtccaagttccccatctcagaaagttctggaaatcagagtccagcttggtgcactccccgcagctgcaagctccactctgaatgttggcttcctcttccttgtccccaacgccctataggaagcgcctggcatattgcaggctccagagagtgcccagttacctccctccccgccccaccatgttacagaaggagaaactgaggccggagctagggggttgatttcccagagtctcctgcagggtggcagtgttgaagcacctgagctgtggctgctctgtgcaaccatgtccagagtggggtcgccagctgcttcccaggctggggacacagagtgaagtccaggacagaacacaatgcttagtcaagagacctggtcaggcctagagcccttggcaaggccctttccctctggtctcagtgtccctgctgtaaaataggttgactgagttgaccgagccaaggatgtgtgtgctgttggcctgccggccaggccccagggcaggcttcctgggacatcagctgtgtgggctccagggggagaggggaccttgaattccacctctgggcttgagctctagggcctctctctctcccctgttgttggaaggtggctgcatgcagggtcttccaatatggctgtcctggaggtgcccctgctgtcaggcttccgggcagacatcgagagcctggagcaggtgaggcagcgccggtgagcagcggtgggcagggatctctgaacaataggtagggcttaggcacccagggtcaggctggctggcagtccagacctttgtaaaatgctatgggtattcttttcttccctctccctctccccctcccccttcccctccccctccccttttaccctgtttctctttcttttttttgacatagtcttgctctgttgcccaggctacagtgtaatgatctgatcttggctcaaattcccagtggagccttgaacttccaggctcaagtaatcctcccacctcagcctcccgagtagctgggactacaagcatgcactaccatgccctgctaatttttgtatttgtggcagagacagggtttcgccatgttgcccaggctggtctcaaactcctgggctcaagcaatcctcccgcctcagcctcacaaagtgctggggttayagacatgagccactatgcccagccccttttttcctcccctttctgggcaaaaatggcccatctgtctactgaggagtagrtggggtgaggtgggggctgctccaacaggtggatctcccatgcggccactgtcactattattattattattattatttgagatggagttttgctcttgttgcccaggctgtgcaatggcacaatctcagctcactgcaacctccacctccccggttcaagcaattctcctgcctcagtctcctaagtagctgggattacaggcatgcaccaccacgcccagctaatttttttgtattgagtagagatggagtttctccatgttggtcaggctggtctcaaactcctgacctcgggtgatcagcccacctcagccttccaaagtgctgggattacagatgtgagccacagcaccgggcccactgtcacactattataaatgccacctagaacttcagcaaagttccatgtgctttggccctgggtggggagccatggggtattctcaatccacattctgccgagaccagctgtcaccctcacaaccctaagacagaccagtgccatgtccccattttgtacaggaaggaagagggacatgggggtggggattgctgcccggctctggctgggggagaaagaggaccaagaagcgagggtttcagggaccaaaggaggtctgcagtgtggggagggtggaacaggaaagctgggcctattgtcacctcccctccaaggaggctgcacggagcaccaggggatgaggatgtggtcaattcagaggccttggagtgggtgtggatttttttaaatcaaaaactgaaaaaaaaaaaaaaatcccaggctgggaggggaacttgaacagtgcagctgagacaccagcaggcggcagggctcagccgggcacctctttggccacggagaagcctgacctgggcttggggctgggttgagggagtgtatagggaggcgaggcaggtgctcccagcggggatagccatccttgagcgtcctctcctgggtgctgagaggctggcagggcctggggagcactgaccagcacccagaccccagcccatggtaacttgtgggcaagtccaagcatcccactgaccactgcccccaggggatgggagaggaagcaagtagagagtctgaggacmctgacttctggcttcctctgcagctgctccttgacaagcacatggggatgaagaggtatgaagtggctggacgccgagtgctcttctactttgatgaggtaccaccagccggggttggtggaggaggcttccctggtgtgcatgttggtgagggtgcaccggtcactgcctggtgtggctccctsmaagtatcttgtaccataaaaaagacactggggccgggcatggtggctcatgcctgtaatcccagcactttgggaagccgaggtgggaggatcacttgagctcaggggttcgagaccagcctgggcaacatggcgagaccccatctttacaaaaaatataaaaaagtgcccaggccctttggcttacgcctgcaatcccatcactttgggagactgaggcaggtggatcacctgagatcaggagttcaagaccagcctggccaacatgacagaaccctgtctctacaaaaaacacaaaaattagccaggtgtgatggcacgctactgtaatcccagctatttgggaggctgaggcaggagagtcgtttgaacctgggaggcggaggttgtggtgacctgagattgtgccactgcactccagcttgggtgacagagcaagacctgcaagaccttgtctaaaaaaaaacaaaaaaaaataagacactgggagaataaattccaggcagagttggccatgctgacagctctgtgccctcggctgatggcagttggtagaaaaagcagggaggggccgcagtggatattatccatctgtaggaaggagcgaagcattgatccatgctacagcatggatgaacctcagaaacatgatgctgagtgaaagaagccagacacaaaaggccacagagtacatgawtccattgacatgaaatgcccagaacaggcaaatccgtagagttggaaagatttgtggttgccaggggctgggggagtggggagtgagtgctgatggcgatggggtttctttgggggagaaagaaaccgtyctgtaactagacagaggtgatgattgcacagtatcgtgaatgtgctgactcccacccacacatgctcagccatgcgtgcacacacacaaaaaggagtggtgtttcagaggccacctgagacgttttcccagtgggatggaaggacccaaagaataaaaaatgggaccgaggcggatcacttgagggcaggagttggagaccagcctggccaacatggtgaaactccgtcttgatcaaaaatacaaaaaattagcagggtgcggtggtgggcgcctgttatcccagctacttgggaggctgaggcaggagaatcatttgaacccaggaggccgagcttgcagtgagccgagatcacgccactgcactccagcctgggcaacagcgcgagactctgtctcaggaaaaaaaaaaaaaaagaaaagtaaaagaaaaaaagaaaatgggatcacgtttcttctgtgtttcacgcgtcctgggtatccctgaaatcagccagttctgggcctgagctcagcgccccgggcctcctggcccgggtcgagcctgcgcccgccgctgccccacagatccccagccggtgcctgacgtgcgtgcggttccgtgctctccgggagtgcgtggtgggcaggacgtcggcgctgccagtctccgtgtacgactactacgaacccggtaggcccgcgcgcccgcacccccggcccggcccggtccctgacccgtcgcgcctgcacttggtcacccgccaccctcgtcccgtagccttcgaggccactcgcttctacaacgtcagcacscacagcccactcgcccgggaactgtgcgccggacccgcgtgcaacgaagtggagcgcgcccctgcccggggcccgggtgagtgcgcggagccactgccgccccccaccgcggcctgccacaccccgactcccaccctcggacgccagggagggctcccctgggggcttggcagaggaggggccaacgtaaagtcaggagaacgcagcatagaggtgggcgggcgctctgcctgtacgggggaggcggggctggaggagcggtcagcggggaggggcgtggctgggggagtggtaagtgcggaagggaagtggctggggaatggtcagtatactgggggcagggccgagccagtgagggtgtggtcactgtggtggggactgggcgcaatgggttgagggtggtcagtgtggtgagggcggggtcgagcggcgagggggaggtgagtgcggagggtgcggggttgagggcgggwgtgttcagtgcggggggcggggccgaacggggtgggtgtggtcagtgcgaaggggacggggttgagagtggatgtggttagtgctgaggggatgaggttgcggtgggtgtggtcagtgcggggggcggggtcgagggtgggtgcggtcagcgctgaggggcgggatttgtggtgggtgtggtcagtgcggagggggcggggttaagagtggtcaggacggagggggcggggttgagggtaggtgtggtcacsgcggagggggcggggttgaggataggagcggtcagtgcggtgggggtggggttggggtgggtgtggtcagtgcggaggaggcgcggcaggggacggggctgttgttgcagggyggcccagacaggacgccctgtctcctttctctcctacaaccgctttttaaaagtctgtttctgtttttgtaagtattaggcaaatacctgcgtgaaattccataaggccagggctcaggacctcccattaactgtcgcgccccaagacccaccgagggggtagtgggcccgggacccagggacatcttccccacccccaggttctgtgggggcgcgggcaaggttcagggtggggggtctgtcgagcctgcctcgtcccccaggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccmrgccgcgcccctggagcccgcgcctcccagctgctgcgccctcggtgaggaccctaccccccgcctagcctcggggacaccatcgctgctgctctgggccacggatctcctcccctcggcccttgggtcccctccccgccacgccctcccgaccgaggcccccttccttccagagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacaggtaacagctgggcccaccccagagataagagacataggckcaatatctccccacctccctcccctaccaacctcccccgacgacctgccccgactcctccgccccgccccgaccccccactggcagtgggagtgactcagggtcagaggctcagagttcctggggacaaagtgggacattcatcctccctccaccctggyccacgcaacacccaccagcgaacagctgtgcgcgggcgcacgcgcgcgygtgtgtgtgtgtgtgtgtgtgygcgtgcgcgcgcgcgmgckcatacgggtcaaggatcccttatccgaaatgctggggggaccagcagtgtttcggatttcagattttttcacatttcagaatgcttgcattatatagttagctaaggttcagcatccctaatctaaaaatctgaaatgccccaatgagcattgcctttgagcacgtcaagtcgctgctcaaaaagacttggattttggaacatttcagatttaggatttttggactagggaagttttgcctgtagttaacagtgtgcggtttcctcatgggcagatttgtgtaatctcaaccatagtcaacaaacagcccatctgcacaggatccttccagctgctcttccataacttcatctctcccctcaacacctgcaaccactaagccattttccccctacccgtctgtaattttgttattttgagaatgccaggtaaatggaatcagagcggataatctttggagcatgattcccttgcattcacctgtgttgtttcgtgtatccatagtttattctttttttaatctgggctcactgcaatctccgcctcctgggttcaagcgattctcctgtctcagcctccccagaagytgggattacaggggcccgccaccatgcccggctaattttttttgtatttttagtagaggtggggtttcaccatgttggccaggctggtcttgaactcttgacctcaggtgatccacccgcgttggcctcccaaagcgctggtattgcaggcatgagccaccatgccaggcctattcttttatttttcaaacgaggtctcactgtgttgcccaggctggagtgtagtggcgtggtcatggctcactgcagccttgacctcctgagctcaagtgatcctcttgcctcagcctcctgagtagctgggaccacaggcacacactaccaccacgcccagctagtgtgtgtgtgtgtgtgtgtgtgtgtgtgtgtgtgtgtgtgttgtagagatggggtctctgtatgttgyccaagctggagtgccatggctgttcatagacatgatcattgtgcactgcagcctcaaattcctgggctcaagtgatcctcccatctcagtctcccaaagctttgggattacaggcgtgagccactgtgcccggcctggagtttgttcttttgtattgctgggtagtgtgctatgggtagcttttcgatttggttggtggtctgacacaagctactccccycttaccgcacatggacacccagagcccatcactgtggtccactggaaggggaaaggaggcagagttgtacagtgccaggcctgggccatgtgtcccccwtccagttggggttctgccatctaaatgaggaggtggcagctggcctgagccccgtggagttgggttcaggaaaggggtgtggggtcccatcccgaagtcctggcggccccataggaatctttctcctctcctggccagtcagagcggcttctcttcctaacggctgccctgctgagagcaggacgacaccatctggctgcatccygtccctatcagcctgtgactctgtatggtgggtgggcagacctcagcccaggtgacacctgcctctaaatgaacccaaggaacagaatgacagagatctgcccgtccctaggatgagactcttgggacccaggtgtgggctcagcagtcaccrgtgtggtgcaggggggacagctggaggtcccttgggagatcccccaccttcctagctacagctggagctccaagcaccccaaccccccagccttggagctgggcatcattttcctggggccacggcagctcccacagcctgacattctgttcccgggagaagaaacattcccagaaagcactcgtgtggccaaaagcctctttctgagcaaacacgatgtggactaaattagcaaaacatccagccggtgggcaayttcaaaacggaacaggctgcgtttctctgaaacacaaagccccggcctccctttggggcacccaggaccccaaattgccctaagactgtcccagctctcgcaccctctgccttcgccccccggggacctcgggctcacatcacaaggccctgcggggaagcagatggctctcagcaaatgcactttcagcttccggctgccggggctgggtgaccccggtgcttcctcaccgtgagttcctgatgtcctcgtgcccagaggaccagcccactcccagggcccccaggcccagaacctgcctgccttggggggccctaccagctgcctgccaccagtaccagcagactttgattcccctttgtgacccctggcacctgcttatgtctgcatttgcccatcttctccggggtggtatttatttcagccaacaccgctcagccctgatctctgccagcayggaggcccctcgctgcctgtgagatcaaggtctgaggctgccctggccggtgggttccccacccctggcaccctacaagcgacaggccctgtggctccttcctcagcccgaggccccgtgcccacttgctgtagaggatgttgtaagataaaacctcatctccagggtcacagccgggcctcggcctcctgtgagcagcgggaacctggaaagcagcacccagagcgccagcccgttccacagatggggccagactccggcccctcrgagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacamgaatacacgttactgatcttactcacatgttctggggtgcacatgaactttgtgtgtgcatgtgtgtgtgtgtgcatgtgtgtgtcccgggcacctgacacccccagcccagggctgcccaaagttgggctgatcagagacatagacccaatgaggagcccaacagtggccctccaaccctctgccttgcccccatagttcatgccccagtggtctttgaaactgccctgtgccactccctggagtgagcagcggtgtctctgtgtgtgtgtgtgtctgtgtctgtgtgtgtgtttgtgcaccaggtgctgaggcttctccccttccccacacaccagctgtgtcctccacagccactggcatggccccttgtggtctgtcccgtgcaaggcttacaaccggctgccaacatcctggcagaagggagttccaggtctgcagcacccgaaccccccagcacacactgtccacccccaccccccattgtcccaccttatccctggtgacattgacagaaagtgaaaagaaggatcagcctgcaggtgagaggagggaaggcgagggtccccagcagtcaggggatagcaggaggctgagccgtgctagtgatgggttttggggagcagagttgggggtgctattctggttgctcaagagacatcccaaagccagaagctggtgggcatgagaatggccaaccaggctctgggcctggtggggccacagcattgggcactgaggatggggtgccctcagcctcctgggcaggaacttgcagtgagtctccagggaatgcagccccagccccagctccagccccatctcagacaccagtgcgtcgtgggctgcatccagcccagaaagccgagccagagatgctggcagggcccaggaagcagagtttgatcctgtttcagattcctgggctgccctgacaaagtgccacatgccaggcagcttaaaacaatgagagtttattgtctcacagttctgcaggccagaagtccagggtcaaggtggtggcagggctggttccctctggaggctgtgagggagagcccgtcccaggcctgtctcctggctgctggtggctgttggctgtgcttggcatcgtggcatcccttagtttgtgtccgtccgcatcactcccatctctgcctctgccgccacatggctttcttctctgtgtgtctctgtgtcctctcctcttctcttttttttggagacagagtcgctctttcgcccaggctggagtgcagtggcaccatctcagctgaccgcaacctccgcctcccaggttcaagcgattctcctgactcagcctccccagtagctgggtgggcacctccccagtacaggtgcccaccaccacgcctggctaatttttgtatttttggtagagataggatttcaccatgttagccaggctggtcttgaactcctggcctcagatgatctgcccacctcggccttccaaagtgctgggattgcaggtgtgagccaccacacccactatctctcgtcttctttttttaattttagtttgtttatttttgagacaaggtcttgctctgttgcccaggctggagtgcagtggtacaatcatagctcactgcaaccacaacctcccaggctcaagtgatcctcccgcctgtgcctcttgagtggctgggactataggcgcatgccacaatgcctggttcattaaaaaatttttttgtgtgtagagatgggatccccctatgttgcccaggctggtcccaaactcctggcttcaagcaatcctccatcttggcctcccagagtgctgagattataggcgtgagccactgcacctggccgtcacttttcgtctttttaaaattgaattaaattaattaattaattaatttagagacaggctctctgtcacgcaggctggagtccagtggcgcaatctcggctcactgcaacctctgcctcccaggttcaagcgatccttctgcctcagtctcctgagtagctgggattacaggcgccagccaccaagcccagctaatttttgtatttttggtagagatggggttttaccatgttgctcaggctggtgttgaactcctgggctcaagtgatccatccgccttggcctcttaaagtgctgggattacaggcgtgagccaccaggcctggcctctccttatcttatgaggacaccacccacactggatgtaaggcccacccttctccaaagtgacctccgctagtgacagttgtaacaaccctatttccaaataaggtcacattctgaggtcccaggaaggacgtgaagtgggggaagggaccctgttcgacccagtacagccttccccactttgtgtcactggagcaaagaggagtgggtgcccatgccccggctgcccccttccgcagaggccttggaggccacggtgtccccyggcgaccgttggaagagccctgcccgcaccttgtccctgaactcggccgacacgtagtagtagatgaagggatccacgcagctgttgagggtgctcagcgccaggctgggcacrtaggcaccatagaggttgccccaggcgctggggctcrggtccgagtaatgcagcagcagcagcaggttgctgggcacgamgaaggccacggcggaggccagcaccactgcggtcagcctcagcgcgtggccgtagcgccggccgctggccgccagcgtgtgcagggtggccccgtagcacagcagcatggccagmaggggcaggaaacagcccaacagcgccaggcaggtgaaggccggttgccagtgggaggcctgtgcgtccaggggcagcgcgtcatggcagagcacgcgatcggagcgcgccagccggaaggtctgcygctgcagtgtcaggggcagtgccagggcggccgccatgagccaagcagccatgcagagtccaagggccaggcgccggccacgcagggcgcgggcccgcagcgggtgcaccagggccaggtagcgatccaggctgacggcggccagcagcagcactgagccatacatgtgaccatagagtgcggccgtggccaggcggcaggcggcctccccgaagggccagcgctggccacgcaggtggtaggcgatccgcgggggcagcgccagggccagcaggaggtcagcagycgcgaggttcatcagcagcatggtggagggcagccgaggtgcctgcgtggccagcacccacagcgccagcccattggccggcagccccaccaccaggaccagcccatagagggcgggcaccagcctggtgggcacccagcccagaagcagtgcccgtgagctgtccgggagctccagggtgtcactgtcattggcacagacttggcctgggtagccgcggggggcaggcaggattgagggcgtgctgtctgggagagagaggggacctcagtcagcccctgcctcggcaggtgacgagaagcagcagggagggaggtgctcagagcctggggtctgccctggtgggaaacagctggacatgacactcaagggaatagcccagccctatggggtcagagacgggatacagagtgggctgggctgaagcccgcaacttcccggcctccccctccccagctccgggcccccagctccatctctgatgtaaccccatctctgcaccccaaagccaggaccactcaccatcaccacctccggtgctcccgctctcgtcgtagacgctgggggtctgggtgccgccagacaggctgaaccccagcaccaggggccacaggagcagtcgcccccacatgactgcactcaggctgctctgggctgtggcctcaggcttcctgcctcgccggaccctgagccccagcttctggagccgaggcggacgagcagatcgcgccggtggagataaaccaggaaggctgcccctgcccccgcagacccaccagggccgcttgccagccagcccgtgggaggactggagtgtgggttatggagaccgggctgccccacgtggctatatccagtgtggcgcctcccagggacccaggtgccaggccagcaagatgcaggggggggtcccagctgcagccagcacccccggtccctgaccagcccaggaagcatctgcggttcaagtggccacttcctgccagccgctcacatctgcagccactgttctcacgacagccctgtcctcaccccaatccccacgcccatcacgggctctgggcctttcctgaagtcaccccccgacttcctatctctggtgagcaggataagaagagccctgctaggccaggcacggtggctcacggctgtaatcccaacattttgggaggccaaggcaggcaaatcacctgaggttgggagtttgagaccggcctgaccaacatggagaaaccccatctctcataaaaatacaaaaattagctgggcttggtggcagatgcctgtggtcccagctactcaggaggctgaggtgggagaattgcttgaacccaggaggtggaggttgcagtgagccgagatcttgccactgcactccagcctgggcaacagagcgagactcggcaaaaaaaaaaaaaaaaaccaaggatgggcgcctcccagagggtaatagcgagggtcccttcagacccccagagcagcacgagcccagcrtcagggactctggctgaacctcgagagcccctcagcatcctcggctgaccccatactcacaaggcacccctgtatgagtgcctcacttcactcttgcccaggggacacacgggcatctgtaggggagacagtgatgctggggacagcacctgccgaggaccggggggacttcggggtgtgtggctcgcctgctctgacctctgaccctgagtgaggtggccaggttgaagggtccccaagccagcctccagggggcctccctcctctagccccagcacatccccactcctgggtaccattggatgggggctcatcgggcagatgaagaaactgaagctcgggggggtaccccttccctcttctgcacaaggcccctcagtgttgtccctccctgcctcagagaggcctcaacccgtcgtgccctgggggagtctggtatgggtggttctggccccagtgtgctcagcgctgggctacaggggatgggggacagggcttgggggggtctgggagcaggagggcctagttgggagccatgaggattggggaaaataaaatgaactagggatgggggagggaggggtccaatgtggccgtttcctgcctgggggagccctaatctcatcacacacttgagcactcggggatcagccaggaagtgactgagcagagtcttggacagagtcaacacccagctccaggaggagacactgaagcctggagagagagtctagctggggcagggtctcagaggccctgctcccatttctgggcagtttccatggccaccaatgagaaaatcagcttcacgtcaatgacttggggaaaaaggtggctgaggacaccctcagcacacggaaaacccacgcctgggctcccccctccaccgtcttctctgtgagcagagtgggaagctgtgcaggggaggctgggcacaccggcagtccggtgatgctggggcagggtggtttgaagatgatgcatcaaaatagtgatgcacgaccgggcgcaatggctcacgcctgtaatcccagcactttgggaggccaggtgggtggatcacgaggtcaagagatcgagaccgtcctggccaacatggtgaaaacccgtctctactaaaaatacaaaaattagccagacatggtggcgcacgtctgtagtcctagctcctcaggaggctgaggcaggaaaatctcttgaacccaggacgcaggggttacagtgagctgagatcacaccactgcactccagcctgggcaacggagcgagactccgactcaaaaaaaaaaaaaaaaaaaaaaaaaagccaggcacagtggctcacacctgtaatcccagcactttgggaggcagaggcgggtggatcacctgaggttggg

SEQ ID NO: 12385 - DNA, 41973 bp, Homo sapiens
gccatcgaaaagagttttgtttgtttgtttgtgtttgtttttgagacagagtctcaactctgtcacccaggttagagtgcagtggctcaatcatggctcactgcaacctcaacctccctaggctcaagccatcctctcacctcagcttcctgagtagctgcgattacaggcgtgtgccaccacacctggctaattttttgtattttttgtagagatggggtttcggcatgttgcgcaggctggtctggaactcctggcctcaagcgatcctcctaccttggactcccaaagtgctaggattacaggtgcaagccactgagcccagccgaaaagatctttgtttcctgtttttttcaacattctactggctttgtccatgaagtccttcatcaaacaaaactccttaatttttatgtagccaagtttgaagaagcgaaagtttgtagagaagttttttccatccccatctcttctgtaaaatatctgttcaagtcttttgcttacttttctgttgggatgtttgtcttttcttactggttttaagaattcttgatatattgccgggcgcggtggctcatgcctgtaatcccagcactttgggaggccgaggcgggcgggatcacgaggtcaggagatcgagaccatcctggctaacacggtgaaaccccgtctctactaaaaatacaaaaaaattagccgggcttggtggcgggcgcctgtagtcccagctactcgggaggccgaggcaggagaatggtgtgaacacgggaggcggagctttcagtgagcggagattgcgcccgccactacactccagcctgggcaacagagcgagactctgtctcaaaaaaaaaaaaaaaaaaaagaattcttgatatattatggatcataatccttccagggagcgttactccctgacatttctggcctaccctatctaccctatgcatgggctgagcagactcatatgcccagggaatgcttcaggtaagaagccatgggtatgtttaggaactacccgttaaagctggaggtgacatctgggatggctaagggggtgtgggtgaggctccgacagtatttgctgtacccacgttgtccaatatgaacagccacccatcatttaagactccttttgggctgggtgcagtggcttacgcctgtaatcccagcactttgggaagccgaggcagggggcggatcacaaggtcaggagatcaagatcatcctggctaacatggtgaagccccgtctctactaaaataaatacaaaaaattagtgaggcgtggtggcacacgcctgtaatcccagctattcgggaggctgaggcaggagaatcgcttgaacccaggaggtggaggtcgcagtgagccaagatcgtgccactgccctccrgcctggatgacagagcaagactccatctcaaaaaaaaaaaaaaaagactaaaataaaaaagactccttttatcctcttgttatctgggaagcttttcctaacctacctactccaccactccttccaaacaatagtttttctgtattgctatgagaccgagtacctaatctcattttatagtgttttatgcctgtctgttggcttatctgtctccttcactagtgtgagatcctcaaggcaggcaccgagtctcatccacctctgattctctggtaccgaacacagggcttggcacacactatttgctataacatgtgctaacacttgttaagcacttaccatgtgccattcgccatgctaaaagctttatgtatattatctcgcttgatttttacaacaatcctaggaagtaatatgttcctctagatgccacaggattgacagaaacaaaactcaaacaactttaagatagaagtgaattttactagttcaattaaaggaaaatctagaaacatgccttcaggcatggctggatccagacactcattgagcagttggggttctttccctccatctctcagctctgtttctctccatcaggcttcattctgcaagcaagctcactctacaaagagggggaagctagctgccagcaacagttgtatcttcctacttagcaaccacaatgggaaaaaccaacattcccactgactcagcagaaaagcgaggtctctgattggcgcatcctgtgtcaactgcttgtacctgctcatggggtggaagcacaatgattggcagcccaccaagaggtcttgcctaaaagaaccaaaataaaacaaaagagatgggaagccttcctgagcagaataaaaccatgatccaccagagatgggtccttgtgttgtcccattgcatcaatgaggaaagaggcacagatcacttgcccggggataccactggtgataagtagcagaaaaaacatttaaactgatgggtctgatgtcaagtcctgcaccccttgtccatccattatactggctcctcctatgaattctgggatggatgagagcccaggattcagatgacagacaaactcaggtttaagatctattattattattattattattattattattattattattagacagtatcttgctctgtcacccaggaatgcagtggcaacatcatagttcactgcagcctcgaactcctgggttcaagccaccctcccacctcagcctcctgagtagctgagactaaaggcatgtgccaccatacctggctaattttttttttaattttcgtagagatggggtcttagtatgttgcacctgctggtctcaaactcctggcctcaagcgatcctccagcttcagcctcccaaagcactgggattacagacatgagccaccgcacccagcctgagatccttttttgaggctgtgatctctatgagctcaagtgtcctcatcagtcaaatatgggcaataatagtatctctatctggtggtgaggattaaatgaaatcattcaaataatatatttagcatagggtctggcacataaaaagagctaaattaatgttagttcctattatcaataactattcattgaatgaataagtgagtgcatggtacctagactctaacatgaagactctggttagactctggttagagatgatacctcacgtatcatctcacggtgtgaaggcctgggagcagggtttagggagggctttggacccttgaaaatctccaccacggtgcaaaacactctccatggattttctattctttgagctgggcaattaacttttcttaatttttctttctttctttctttctttcttttttttttttttttgagacagggtctcataacataatgttacccaagctggggtacagtggtgcaatcacagcttgctgcagcctcgaacacctaggctcaggtgatcctcctgcctcagtttcctgagtagctaggattacaggtgcacaccagcatgcccagcagattttttttttcagatagggtcttgctatgttgtccaggctggcctcaaactcctgatctcaagttatcctcccaccctggcatcccaaagcactgggattacaggtgtgagccactgcaaccagccaacttttcttagttttacataaagtaaaaataaaagcatgtttagaaagtgctgttcatattattgatctgtaacttagctctaagcaagtttccaagcccactttctccttccaaccgaatgaccaccccaagccccttccattaggaattctaggccaggtgcagtggctcacacctgttatcccaggactttgggaggccaaggctgacagatcacatgaggccaggagtttgagaccagcctggccaacacagcaaaaccccatctctagtaaaaatagaaaaaaattacctgggcatggtggcacacacctgtaatcccaggctacttgggaggctgaggcacaagaattgcttgaacccaggaggcggaggttgaagtgagccgagatcacgccactgcactccagcctaggcaacagagtgagactgtctcaaaaaagaaaaaggaattctagagccaccactggcacccacgctccatacagctgggtttggaatgagcgctgtcctcaygtatgaccacgtgcaggtaaagagctttgaaggtgccaagggccatgagtagcttgggaggtcatctaggttctcccagcactgtggagtcaaggagtcctgaaggccggtcccaggcctgggcagggctgggtggggcagactgagacagggcaggggacaggaacgggatgacttattgaggtctctgacaggcctggcagaccagcagggcactacaactcttttcccagtagtaattatacttggcctgaaaaagctttagaattattcccacgttgagtgggcacacagtgtcctgagacatccttggccctctgagatccaggaaactgctctagatgccaaagttatagagacagtaggaaagtgcatgggtggagaggccctcagccccagcaggaggcaataggctgcctctctgagggctggatgcagtgggaggggaggggatctgaagggagaggaggcaaggaggaaaggaagcaaactttacccaactcttcagcggcccagctgggtgtctgcgatgtccacatatggctgagagctccaagtctgggacacagagatgccagcatgcaggacacgagatactgccttgttttctcctcctttcccctgcctttccccctgccccttccccattccccatccaaactctcctgctggccaggggtgtggaaacagttggatgtctttggccactctagctggagttctgccctatgtgatcttggctgagtcacttaatgacaataacccagtttgtgtggagtcacaaatggtgttcacatcataacgtcaccagactctccagccacacccattgtacacgcattatctcattcaatcctcatgacaactctggaagtgaaatcatgttagtgcacccattttgcagatgaggacactgaggcttagggagatggtgtgtgaccttcccaatgtcatatgtctaataaatggcaggaatggaattcaaaccatggtttactaaactccaaagctggagcccttctacagtctcaggatctagaacagggattattactatctctgctgttgacatgaggaaactgtggttcagggaggtcaagtgacctgccaaagcttgtacacatggaaagtagtagaaccaggatgcaaacacatttctttaccaccaacaccaatatctattttgccaacaaaacaatgagggggcctgagtaaataatctcaacggttaactccaccctccaattgagatacttttttttttttttttttttttgagacagggtctggctctctgtcacccaggctggaatgcagtggtgcaatctgagctcactgcagcctctgcctcctgggttcaagccatcctcccacctcagcttcccaagtagctaggactacaggcacatgccaccatgcccagctaatttttgtattttttgtagaaacagggttttgccatattgccaaggctgttctcaaactcctgggctcaagcagtcctcctgcctcagcctcctaaagtgagccaccacacccagcagctgagacactttttaattctgggctagggcaaagagaagttggaaggaaaatgggtgaaaataaagaagttctcagttatactgcagcttgttcatgcctcctgcctcgggatgccgcagtggctgccccagccctgccctttcagcctcagcccttccctcagtgaaggagagaaaaagtgatttaacaaagtgaggactgtcagcccttggagcttggacctttgagatctcacactgccccacccagtagcttccccttccagtagcgtggcaccaccttctgacccacccctcagtgtgtccaccagtgagagtggttcctaagggagagtgtgaagcacacgtaggcastgtcttacaccacacctgctgagtccaaaccatgggaggctcctctcctagaccctgcatcctgaaagctgcgtacctgagagcctgckgtctggctgcagggacacacccargggraggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaaggtaaaggtgggcaccccagggtcccccagcccagcarcctgggtggtgggtcagaggaagatgtacaggaagaggcgcagaggcacaggcagtggcaagagcgcggctctgtcccttcttcccccagtctccgctggaatgttcctaccctgccgactgccccagaccgcgctcaaatgtggcttaaatccagggtctttcaatgcttagaggactgggatgaggaaggaagttgratgggaggcaggaaggggaggccataaatcaaaaacatcaacagtcctggggtgcaggcagggagagsgttcgtgctttcccagcctcggatatgtctggcaccttactgaggcttccacaacactaagtccacacctcctgcccactgacctaagtgttaatgctcgtctttagatgaaactacggaggtctcgagaggtgacatgacttgcccaaggtcacacrgggcgctggtggtgaaaccctgggctggaggttccccaaagccctgctctcttccttccacccactgtgctcagtgctggccagggtggtgacgtgtttgtcgggggtggtcggtggagaatcttggaggagaaaagccagctgggctttcggagtccagcagtgagcagcgccctgcggggcgggggcgggtaatggaacctgarcccatctgagtctgctctaatctgttcctaaactcttttctttgatttattgcttttgtagaaaagttcatgtgagcaaaaattcaagcttgtttttgmtaagcttagaggcattctccttcagggcagtaggggacatggtgtggaggtaccccttggtattattccctgtctgttgaggttctgtcgggtgtgacttgcctgggtcttaaacatctttgagtgggagaagcaggtttgattgagtgctaacagcctgtgaaaggaaggtgattaatgctatccatttaacccctgcaaccctgaaaggcagagaaggaaacaggtttggaaagtttcagagctcraaatcacagagctgggattggaacccagacttcccctgactccaaaagctgttgctctgtggggagtgaaggatctctgagtaccgtgttgaaattcagacctgttttggtggctgaggtgaatattaaacattaaccaccaccacaaacaacaaacattcaccaccaccgcaaacaccattgcaactcacaacattgcagaatcttgaatgtggaaatcagcccttgattctttcgaaagcctccacatcctttccagatggcacagaaagggccctcctacaatcccccggcacccacactgacccctcctgccrtgcttatcacatggtgtcatcactgtccacttatgtatctgcctctcccttgggactttgtgctgcagagggcaggagctgtgtcttgaatctttgtrccattgactttctcgtgctgtgacgtagcacctgcctggctcagaacaggcactcaataactgttgagtgactgattggatgaatgaatgagatgagtacgtttggagaagcagaaggaagagggatggtggggcaggtggtggtgatgggggctcagcatgttcggccacagcatttcctggcctgtggggccagcatggctgccttccatccatgctttccagcactggaactggtgttctgcttggaacagcaggaggtcagacagcctcatcgtgcctccagagccaggggacccccatgccagaatgctygggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccrggcgtggtgrtgggtgcctgtagtcccagctactcgggaggctgaggcaggagaatggtgtgaacctgggaggyggagcttgcagagagccgagatcgtgccactgcactccagcctgggcgacagagcgagactctgtctcaaaaacaaacaaacaaaaaaaaacaaacccacaataaaggaggcacactttcactcataagtgacacctgggagctccttccagtgaagtccacacctctgtcaccctcatactgatcattcaacagatatttgctgaacatcaactctgttccaggtaaggtgccaggtgctggggatatcacagtgaacagggatgacacaatccctgcccccatggcagtcccctcatattgcataggtgatgactgaaggckcgagcctcatccagtggaaggaaggaatggaggagataaacaggactgtggcccatttgcattgcagggaaagacctggtgtcaccagagaaagggttgtgtgatggggatttagagagtgaaatggaggcttcagagtcagaggttcctgggttggaaggctggtgtttatcaactgtgtgactctgggtgagacccttcacctttctgagtgtcagctcatacattttatttatttatgggtttttttttgttttttttttttgagatggagtctcactctgtcacccaggctggagtgcagtggcgcgatctcggctcactgcaatctccgacgcccaggttcaagcgattctcctgcctcagcctcagagtagctgggattacaggcacccgctacacacctggctaatttttgtacttttagtagagacagggtttcatcatgttggctaatctggtctcgaactctgaggtgatccacccgcctcagcctcccaaagtgctgggattacaggcatgagccaccgcacccagccagctcacacattttaagccagggatcataaaacccacctttcaggatgactgtgaacagaaccagattcagctggtatgctggtatgcctggcacgacacggcatggcaggcagcattcactctgatcggttggtgcctgcgctgagtatgtagaatttcacccctggttgtgaggctttaaatgagtaaatgcttataaagcattcagcgcattttctgcctcgtaataagaaggtcacaaatgatagctgcttctgctaccactattaatgctatcattatycttattatctggaggcagattgtggaggacttttggaggccaaacagagacactaagatttgaagaggtaggaagtagggagccaaggaatgttattaagaagaagagtaacataaaagtggtgtgtgatgacatttagtgtgacaggtgctcagcaagggcggggacagaggaacagtgtcagggtacagtatctgctccactcactgacctgtctgcagtgtcagcacacttcctggcctatcactgggcctctgtaaggtttgttgaacacatgaatgaaaggcttctactaggactgggacaggtagaatgaagagaaaggaatgatccgagagatattgtgtgggacacatggaccgggcctggcatgggcagtgttacaaataaaggctgggtgcggtggctcatgccagtaatcccagtgctttgggaggatgaggctggaggatcccttgagtccaggagttcgagaccagcctggacaacatggcaagacgtcgtgtctacaaaaagtacaaaaatgagctggatgtggtggcgtgcatctgtggtccyagacacttgggaagctgagatggagggatcacttgagccccaggagttcraggctgcagtgagctgtaatcacaccactgtacatcagctgggcgacagaatgagaccctgtctcaaaaaataaaaaacaaaataagaaataaagtaaaggcacatggctttaggatcgccagccaggtggcccaggtgaatgatgatgaggcactgactgaggtgaggcattgaaggcatggctggactgtgtgctggggacgtgctgggcagggaccagcagcagtattcgaagctacaatggagtgagctcactaaggacttcatttagatgacctcctgtaatatcacagccacctcatgatgggggacaatgagtttcacatgcactaatcagagtacttcctatggtcaacgtcagaaagcaaccagaaccagagcgggcaagggtagtgcttgtctcagggtagctggatccaggaacacaaacatcaccacatccttctttatccttctgggtgcaggtctctttctcttgtcctgcaggtgggctttttctgggcatcagggaacatgagtgcaagcagtctctggtttccattcttttgtttttgtttttgttttaaaggcagggtctctctgctgcccatgctggaagtacagtggcgcgagcctagttcactgcagtctcaaacccctgagttcaagctatcctcctgtcttagcctcccaagtagctgggactacaggtatgtaccaccatgcccagctaatcttttttatttttatagcgatgaggtcttgctacgttgcccaggttggtctcgaactcctgacctcaaatgatcctcccaccttggcctcacacagtactgggattacaggcatgagccactgcacctggcctgtttatcattcacacattactgaagtaggaagtgaggccaggtgcagaatagggggtggatgcagtaagttggggcttggagcagggggcacctggacacccagaggaagcctggtgtggtttcatggggtgaagcagagctgatcaggaggcagaaacggcacagctgagtttagacactgtgagtttacagcttatggcagaacaggtctgcccaggtctgtgactttctccagctaaacacaagaccggcacaggtgaaggcttccccctccaaggcagctggtgtcccatccaattcaaaagcaggcctggctgcaaagacggccttgctatcgagacttcataatgatcatcattttctctctgttactcccaaccctggccagggccttgtgcccctcacagatgggccacccaggatggtgattaacaactacagcaattaggttttcatgatgcacctcgggctggtaacattcgtgactgcttgtggggagagccgagggagaggtacagaaagaggagctcactggtgaggaaagagctgctaagggaaaaaaaaaagtgaggacacaaagaggagagtggagatggcacagaaggaggattgagaaagcaaagaaaatgggccaggcgcggtggctcatgactgtaatcccggtgcttttggaggccgagctgggcggatcacctgagatcaggagttcgagaccagcctggccaacatggtaaaaccccatctctactaaaaatacaaaaaattagccaggtatggtggtaggtgcctgtaatcccagctattcaggaggctgaagcaggagaatcgcttgaacctgggaggtggaggttgcagtgagccgagatcacaccactgcactccagcctgggcgacagagcgagacgccatctcaaaaaaaaaaaaaagaaagaaagataaaagaaaagaaagaaagcaaagaaaatggtccacggaaacggagtcagctccgggccttgcacatggctgaggctcagccggtgttcrtgcagcgccgggtgggtgatgggcagggaagagaaggaccacctgtaaccctaggggcactgcacgaggtgtccctgggctcgtggggagtatgcatctggcgatgagaccacgacagtgccagaaagggtcccaggatggtgcccagacacaagacttcttggctgtagtttctgccaactctgctggcacaacccaagggatgggagggtttatcttcttcagctcatgaccttaggacagtggtctctctccctctttcctcctcctttcctctccgtctgccatttagggaaaaagccactttactcaaccagctggggtgaattctgagaggaacacaccacattttagaagacacttgaggatgtcttggttaagtaaccactgaatccagcctaccttggcttaattcttaaatctgagtcttccattttccctcaaaccaccccctgctgttctgattctgtccctggtctccctttctctgcctggatgcattttcctagaagcatttcttggtgcctgacaccagcccctctcttcagcagctgatggaccccaggccccatccccccaacaccacagcatctctggtctaggtaagagcaagcttctctaacctgggtcttcagcttacagcccagctcccatcacgccccgtttcccgctgtttccccctgccaaggaacttcagttagtcctctccactgtcactcaaaagtggctcattttgtgaccagcctaggcaacagggtgaaaccccatctctacaaaaaatacagaaattagccaggcgtggtggcacatgcctagagtcccagctactcgggaggctgaggcagaaggatggcctgagccccggtggtggagattgcaatgagccgtgakcacgccactgcactccagcccagcccgggcaacagagcaagactctctcaaaaaaaaaaaaaaaaaaaaggccaggcacggtggctcatacctgtaatctcactcagcactttgggaggctgaggtgggtggatcacctgaggtcaggagttcaagaccagcctggccaatatggtgaaacctcgtctctattaaaaatacaaaaattagccaggcgtggtggcaggcgcctgtaatcccagctgctcaggaggctgaggcaggagaatcgcttgaacctgggaggcggaggttgcagtgagctgagatcgcaccattgcactccagcctgggtaacaagagtgaaactccatctcgaaaaaaaaaattgtctcattacataggcaagctttactacagtccctcgactaaatagctgagttcgaatataattcatacctgaaatggtgcatttgcagtgggaggaggttaggaacatggagagagtgtcgtatttcttcaagtatatggacagaacattcctcacgtgattctcaaacgtggtcccagaactgcagcctcagcagctcctgggaacttgtgaaaatttgaaatttttgagctccaacccagcccagacctattgaatcagaaactccaggaaagaggcttacaagtgtgttttaagaagccctctactcaggaggcaaaggcaggaggattgcttgagtccaggagttcaaattccagctgggcaactaataacaagaccctgtctctaaaaaatataaaaataaataaatttaaaaagagaagccctccaaaacattctgatgcccacttgcttgagtgtgagaatactgctttaatcttgctaggatccctcagaaaagagagtgggtgcagtgctttctggcattattcttttctctgggtggctgggcccaaatagcctcattgtgagcttctttccctgttgatgtcttttttttttttttttttttttgagacaggatctcactctgttgcccagtctggagttcactggcacaatctcagctcactgcagcctcgaccttcctggctcaggcgatcctcccaccttagcctcccaagtagctgagatcacaggcatgcaccaccatgcctagctaatttttaaaattttttgtagagactgggttttgacatgttgcccaggctagtctcgaactcctggactcaaacaatgcacccacctcagcctctaaaagtactgggattacaggcgtgagccaccacactcagtcttgctgatgtcttaataacatctgaccgcagccctgccttaagcaccaaaccacctcaaaacatggccttccttcctgcaaggccatagagaataagaagagtctggccgggcgccgtggctcacatctgtaatcccagcactttgggaggccaaggcaggtggatcatgaggtcagaagatcaagaccatcctggctaacatggtgaaaccccatctctaataaaaatacaaaaaaaattagccgggtgtggtatgcaatcacagctacttgggaggctgaggcaggagaatggcgtgaacctgggaggcggagcttgcagtgagccaggatcgtgacactgcactccaggctgggcgacagagcgagactccgtctcaaaaagaaaaaagaagagtccatcgtatctcacaggccaggatgcatgttttggcctcctgccaccagccttcacttttaccttctgtaaaatggtgttctaacagtatttaccttacccaacagttaaaaggattaactgaccttatgcaggtaaagcactccacagagtgcctggcctatgagtgcccagtaaaagaaagcaattagtaatactggcactatgatcgtagtattatttggtcctatcttattattatggatttctaacttagcaccatcccaatctctctcatgtatgttttgaagtaagcaaaggcaatagcaraaacagaattggtttgcctggtcagaagacagcctgctttctgggctgagagaagcaaaacaaaattgcacagcatttcaggatgcagtacgtgggcaaaggcttccttcctttttttttatttgccttttttttttttttgagctagaaaattcaaggaaattrcttgaatttgttacaggctccaaatacagttattcctctgcgtcttaagcatctagmactgaagtggaaaattccactctttcaataatggttagccatcttagctcaggccatgctgtggtttgaaggtttgccccctccaaaatgcataagcgtactttggagggcttctcttttcaaatttattatttatatacacttttagagacagggtctcgctatgtttaattgccaatgcaacagtgttgggaggtgggacctaataagaggtgtttaggtcatgagggctctgcccggtgagtggatgaataccgctataaaaagggcttacagtatggattctctctctttcactctcctgccacatgaggaatagtgttcctcccctccagaggatgcaatgttcaaggcgccatcttggaagctgagactgggtcctcactagacaccaacttgccaacagcttgaccttggacttccaagccttcagaattatgacaaataaatttctgtcctttataaattacctagtctgggatattacgttacagcagcacaaaacggactaaaacaggctgctataacaaaataccatagactagtggtttaaacagcagacatttatttctcacagttctggaggctgggaagtccaagattcagttcttggcgagggccctctttctgacttggccattttctcactatgccctgacaggatggagagagagagtttaagagtctcttcttcttcttataatagcactaatcccatcatgggggctgccccctcacgacctaatctaaacctggttatctcacaaatgccccacctcctaatagtatagcgttgagggttaggacttcaacagaagaattttagggagacacaaacattcaatccataagagaaactgagagccccatgacttcactgttccaggcccaggacataccacaacacatgttagagacaaaatctctgccctcagaaagtttgtaatataataggaggaattagataataaagacatttatttcaggagactgttaagtgctatgaagaaaattaaagcaggagaaatggatacagagagttggaggcagtagtgggaggaagccattttagataggtgatcggagaaagcgtctctgagaaggtgacatttgagcagagccctgagtagggtgaatagtgcgcaaaagggaaagagagttccaggcaatgggaacagcttgtgcaaaggccctgtggcaggagcatactggtgccctgaggggagcagctggaaggacaacaggtctagagaacaaaaggagatgcgagccaagaggtagcaccagatcacatatgaccttggcaccagatcacatatgaccttgtagtcataagaaggatttcaggccaggcgtggtggctcacacctgtaatcccagcactttgggaggctgaggcgggtggatcacaaggtcaggagttcaagaccagcctgaccaatatggtgaaaccccatctctaccaaaaatacaaaaattagccgggcgtggtggcacgcacctgtagtcctacctacttgggaggctgaggcaggagaatcgcctgaacccaggaggcagaggttgcagtgagccgaaattacgccactgcactccagcctgggcgacagagctaagtccgtctccaatataaaataaaataaaataaaataaaataaaataaaataaaataaaataaaataaaataaaacaaaataaaataaaataaaaataaaggatttcaaagtgcctgaaggacagggacaggaccactgtcataccttgttgagaaggtgcagagggtcacatagccctactgccaccaaagccttgatttttatgcaattgataacagcagcagctaacagctgccgaccatttcctctgtgccaggctttgtgttaagtgctttacacgagtgatctcaatttattctcacaacaggactatgagggagattctatcattagygwtttacaaatgaagccagtgagcctcaaagaggttcagtccctttccccaattctcagagccagttgggcaaagagtcccagggcagaatgaaacctaatggaacctctttctacagggtgctgtttgagtagtggggcatgtgagtgtgccccctgccacaaccatctttctttctcattaactggcctattacatgttttacacaaagtaaaggaagatttctstctctgaggcctttctgaacttccagagcagacacatgtgaccatcctgagagactgggtcttctgcaagtgtggaaatgtgctttaacggcatgtcagcaaaacccaagatctgcatgcatcacttttgatgggaaaagtgtcagactttagtcagggatcgggcagggaagctggaagggcggggctgggagagtcactaggctgggagtgaggctggcagggactgtaatctgggagagaggcagaaaccaagtgtagggatgtcagtgaaggtgggagtggtgagcagatatggcaggtgagagtggtgtttaaagaaagtcattttcaggggctgggcatcttagctcacacctgtaatcccaagattttgggaggccgagctgggcggatcacttgaggtcaggagttcaagaccagcctgaacaacatggtgaaaccccatcttcactaaaaattaaaaaattagccaggcatggtgatgcacacctgtaatcccagctattagggaggctgagatgagaatcacttgaacccaggaggtggagattgcagtgagctgagattgtgccactacactccaacctgcatgacagagtgagactctgtctcaaaaaaaaaaaaaaagaaaagagaagaaaaagaaagtcatttcaggtgaggatcaggaacctggctggggagacaaggtggggagcaagaggcattattcatttatacattcaactttcattgactcagcagagagactgagcaataaggggccagttatctcagctataataactaacatttaaataaacaaaagctctcagggttgcaacttcctgattgtaccctgccccatattccaactgtattaactgatctctgtatggtttcaaatgataaaaatacacatgaactattttagacaaaaggaggatgtatggattcctataactaaaccgtgggaagacctggagtgtagccagacctcaggggcaactggcactggccagactcctttctttccatctctmttctctcatccattcttctgagtgtccatttcagcctctctcattggtctcttccataatgaatggaaacatggcggcccacactcagtgtctcaagagagaaactgaagttcccacacagagatgaactctgattggccagtttgagtcaggtgttcatctttatgcccatagcaaggtcataggagacaagatggcagctcccatttgaactacatgctggggaataaagtaagagtcattcctcaggggaaaaaatgtaagaggtgttaagttgtcaaaacagtagatgctcactatagtctaccctttggtgctcagtatacaagcctgttttcttccccaaagtagaattccaaaccagcccccatctaacaccatacagccatcccatgcaccactgtgaccacattcaccctcaccctgacaagggacctgcagctgtggcacccagtagtgtctaatgacatccgtcaactctggacatgaatgcctgygatcctgagaacgagttaaatgactaatcactcctaacatgccaatgtaaataatgaagggaccagaaaatatgtgaggaaaaatatacaagaagataatgaccaaataattcccaaatgtgatcaacacggaacaaaatactgcataatcacaatgaagacttggacttataaaaggaggtgtaggctgggcaccgtggctcacacctataatcccagcaccttgagaggccaaggtaggtggatcacttgagcccaagagtttgagactggcctgggcaaccccatctctacaaaaaaatacaaaaaattagccaggtgtggtgatgtatacctgtggtaccaactacttggtaggttaggatgagaagatcagtggagcccaagactttgaggttacagtgagctatgatcatgccactgcacaccagcctgggcaacagagtaagatcctgtcaaaaagaaaggagaggggagaggaggagaaaggaggggaggggaggggaggggaggggagggaaggctaagttgatgaaatcaataagtatacagtgactcaaacaagatgtggtggcttatttccctcatctaacagaccaggggcgggctggagtccacagcataggagatgtgtttctctgtcctgcaaagttgtcctggagaccagattccttctgtctagatgtcccaccatccctagagttgtgtcctcatctgcatgttcaaactgacacacatcatcacacccacatcatggttttttttttttcgttgtgttttgaaatggagtctcactctgtcgcccaggctggagcgcagtggcatgatctcggctcactgcaacctctgcctcccaggttcaagcaattcttctgcctcagactactgagtagctgggactacaggtggctgccaccatgccaggctaatttttgtatttttagtagacagggtttcaccatattggccaggctgatctcaaactcctgaccttgtgatccgcccgcttyggcctcccaaagtgctgggattataggcttgagccaccatgcccagcctcatcatgtgtttttataggccaggcttgtggcttctttggcgatccaattctatcaaaagttggaaacatcctgatctatttgcttccaattatttccatacagaaatgccacacccagagatcccttctggacatggttctgaagcctgccaactctggcattttcctaactggctcccatgcctggcccattcctgctgccccatcttaatgctggctattgtggtgcctgaaacaacaggctgtgtgggcagatgacacatcacatctttgccacagggctgattcccattgccagggagagaaatttcagtggtgggtaccacggcctgccttcctggttattgcaggtggagctttaccaaataacagactaggaggagtcaccatctggccatcttgcctcatctgtgttttctcctttgcgttgctcaaccactaagccaatgtcacatactttagattttttttgttcaagttgcatctcaccttcagcacaaatgtctgtattagacataggttatgctactataacaaacagattccaagatgcagtgatataaacatggtggaattctctttttctctcacacaacaattcagagtaggccccaggcaaacgggcaactctgccccatgagttgaccaggtttccaaattccttctctctccttgctgctcctccattcccttggccacgcagtcaaaagtgtcccaccccatcacctccaccttccagtctgtggaaggagaaaagaatggaagtaacaggcaagcaacctccttaccaaaagtatgatccagaaatttcccacatcacyttgggccacatcccattggccagaactgcatcatgtggccacactgtgctgcaagggagtctgggaattacagtccctagctgagcggccatgctggaatgggaggcacttgtattacttaaaggaagaaataggaaatgaatactggggaacaactcctatctccgcctcagggaaaaaggcaatttacaaacagtgatacagatggaataccacatcttgctggtcaggggaaaacccagctcccatagtgatttgttcgtagactcacttccctgaatatggggactttcttagccaatctggttatgccaacatcttgcctcctaggagcagccttggcttattgtcccccagcaacaaccctgagagagccaacaggaaggactcccttactgagagctgggccatcttaggagcccacatcccactggaggcccgaggattgttttaagtcttgtgaaatcacaggcaactcgcacaaagctcgaggtgttttttttgtttgtttgttaattgatttcgttgttagttggttttgacagtgtgtttgttttgcaacacaactgacacagaaccctggctgaactctgacagccagtacctaacccccaaaattttgtccaggctcaaacttggaatcaggatctgtcttagtccattcaggctgctataacagaataccatagactgggtagcttgtaaataacagaaatgtattgctcacagttctggagactggaaagtccagggttcaaggcactggcagattcagtgagggcctgcttagtcatagacggtgactccttgctatgtcctcatgcggcagatggggcaaggcagttctctggttttataagtgcatgactcccattcctaggcttggtccccttcattccattctcattatctaatcattcctccaaaggccccacttcctaataccatcactttgggggctaggatttcaacatatgaatttgatgggacacattcagaccatggggctcttagatctcttagatgcaggtgtgggggctctacttatttttgtaagcctcgggatctaccctggccttgacctctgcaggggtgatggagctgcctaatctgcctgttgtgctgccctgctcccaggctgtgcttcatcatggaggcattgggtaaattaagacagtgccaggttcttgggaagggccactaccatgggccaaagaatctaccagtgccccaggtcgaattgycctaattgccctktccttctccccaccttgtttggagtaaccagttccttcctgctttggaatggggcaaacttcttactcaacacacgcaacaggaagtgtctctgccagacataccactggactctgctctcttctcagggtgcaacatagaaaatgcctgctacccrctgggcatctgtgctgaacggaccgctatccagaaggccgtctcagaagggtacaaggatttcagggcaattgctatcgccaggtgagtgggaaagccaggttgcaacaatattcattcatctctttagccaacatcttccttacacatattattcattcattcattcatctgacatatgtttattgtggacttcctatgtgccaggcactgtacagggccctgggatgagtgctgaggataaggagataaataagaaatggagtttgccctcagtgagcctgcaaagcaggtaaataagcaaggcaactctcatacaagggccagtatgcccctgttccagcaacacaacgtgatacagactcctgtcctacaagatwtaacagaaaggcagcattgaaacataaagcggggggaacctgagccaggygcggtggctcacgcctgtaatcccagcactttgggaggccaagatgggcagatcacgaggtcaggagatcgaaaccatcctggctaacacagtgaaaccccgtctctactaaaaatacaaaaaaattagctgagcgtggtggcrgatgcttgtagtcccagctacttgggaggctgaggcaggagaatggtgtgaacctgggaggcagagcttgcagtgagccgagatggcgccactgcactccagcctgggcgacagagcaagactccgtctcaaaaaaaaaaaaaatttttttttgctgatggtggcatgcccatagtcccagctatttgggaggctgaggcaggaggatcacttgagcctgggagttcgaggctggaatgagccatgattatgccattgcactccagcctgggggacagagtgagaccctgtctcaaaaacaacacaaaacaaaaaagcattgagaacagtttggaaaggtcttcaccggcaagtaattatcacagtgttgtaccattggattctcttggcttacttataggttctgtattgtttgaataacaaaaaaggaatactgaaagctgggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttcyggaggaataaatgacggttggcgggcgcctgtagtcccagctacttgggaggctgaggcaggaacatggcgtgaacccgggaggtggagctcgcagtgagctgagatcacgcctctgcattccagcctgagtgacagagcgagattccgtctccaaaacaaaaaagcgggagggacctaaaaatcacctgctatagactcccttgccaccacccccattttatagctgatgaaattgaggccccgataagttgaacaactttcctgggagttagtgccagagctgggacaaaacccaggttccagagtctcactgcagggctcattccactacatcatgctgtgccaggagatggaacacttttccctgttctccacaagctgatgctaggatcctgaatgagccactcagcactgctctctccttcatttggcaacactcacctctaggtccaagaaccaggatacaaaaacagtcaggtaaacagtagttatggttcaaactaatcagagtccagccaaggttctggctgaacaagagccccaatcaatgctcctatatgtcccaaacataaatatcctagttggtatggcttactttccacgggagcatgttgaattcttgttggctctggccctagactcagtggtttcaggatccaagcacgtaaattagcccttttactggactccattattgaatgacttaatggtgaattgctcctgtgtgcacctttgcattgtgtatgacagttttcttaacaagttaatgatgcaagaaaaatgacatgggaaatgttgatcccacccagaaggaggctgcatgcctgttggtctttagggacatctgggtgcataggtcacattctgtgaggtaattatctcttcactcatagtggagttaattcctgtggtagagctryagcacctttctggctaaaatacagaaagagagctacaccttttagcacctttctggctaaaatgcagaaatgcaggggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttccggaggaataaakgacgctgtgctgagaacattttgtgcagataggccaagatcaggatgtgaattgcactttatgaaaaaaaagagaaaaggagggaaataactcaatttcaaagctgatccaagaaaataatgatattctagggaaaaagaggccaaagtcaaccaaaggataatgatgccttgctctatttagaattttccaaatgagaggctttttctcttggtcattatcgacttttaaacaaaactaagtatcactagcaatgattagcaaatgtccttatttacacaaaacctgccatttttccagcacccaactgctgtactctrggtattcagctcagtttccctgagcccaagatgcactcattatcgcactcatgatttgttaaattgagarcgtttgtggatttagaggatgaatgagaagtaccagctcccttgttaacatcagatgggtctgagcaacctcagagagaacccctctcaggtctttaaggatggagaccgcactcaggaaaggtccgtgtgtcttactgctcacagacagatgagactgccccactgggtcccagctgtagtgatcagagtcagtaggtttccagcccgtcaagtctgataagtacggcctcagtgtgtgaccaaggtgagcacaaaccacagaaaactgtaaatagccagcaaaaggcaggacagagtgaagggcagggtagagggagaaagggggaagctgtgaagaaacatcctgaggcagccagcaggtgctcagtcttgagtgctctctcttggcaggaacgttgagtaagttagaagcccaggcttcagggtcagtgaaaccagtttccaaatccagccgcattatggaccttgggcatgctgcttagaccctgagcctggcttctcatctgtgaaatggaggagactggtctgttacagggtcttaagaaacgatttctgtaaagttcctgacacagggtatgtaatacattcaaactattatatakttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacaggtgccggccagcacrcctggctaatttttgaattttyagtagagacagggtttcaccacgttgaccaagctggtctcgaacttctggcctcaagtgatctgcccacctcggcctcccaaagtgctgggattataggcatgagcaaccgcattcagcctcaaactattayattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacmgcatgcaggtgataagagcgmctgcataccccggccccttacagggttgttgggggattaaatgaactaatccacttaaggtccttagcacagaggctggcacacagaaccactatgtatgtgtaagccattactgttaatgcgctgtctctacatcctcagtgctaggctgcctggaaacactatcctgygacttttggttgttgaagcctacaccaaatctaccttcccagtggaatgcatgcttgcccaccttgaaatccctgatgcagatcaccttgtccagggagctagccattgggtagtgggccacagatgccacaagattcagaaagaaggccgggcgcagtggctcatgcctataatcccagcactttggaaggccgaggcaggcggatcatgaggtcaggagatcgagaccatcctgcctaacacggtgaaaccccgtctctactaaaaatacaaaaaaaattaaccaggcgtggtggcgggcacctgtagtcccagctactcaggaggctgaggcaggagaatggcgcgaacctgggaggcagagcttgcagtgagccgagatcgcgccactgcactccagcctgggcgacagagcgagactccgtctcaaaaaaaaaaagattcagaaaggaagcggtgagctcagcaggggtcagatcacacagggccttacaggccatgaaaggaaggctgaatttcattcagagcaactctcccatggccctaaccatgcctttgttacggcatttgtgtgaaattttatctccccctccagagggtaagctccaggaattgtccgattggtytttgttgctcctttcccatgcctgcctgacatagagaaggattttggtcgacatgtstggaatgaagtgaaraataacccccaaaaagcttaagaggccctggctgcaacagctgtcacccagtaattccaagagttcactcggcatcctgggcaggagtccccaccctcttatgtgcccgtgggtttttcttctgaagctggaagcgtcctcagagaggtccccatcatcccatggaacagaacctttcattgactggacccccacatgtaaaaggtagtaatggtgaggattagagaaaatagcacctcagctgctttattctaatcataatatcatccctatctccacttgacgcatgtggttggttggttgggtggttgatcagttgcctagctcccctcactagtctataaactcctgagcatagtgaattttgtctgttttgttcactgctgcactcctagcaccaatgacagtgcccagcactgctcagtaaatatttgttggttgaartgagacaatgcatataaaatgctttgcagaatgyctggcacattctaggcacacattatcttttttttttttattttattttatttttatttttatttatttatttttatttttttttgagatggagtcttgctctgtcacccagactggagtgcagtggcatgatctcggctcactgcaacctctacctcccaggttcaagcaattctctgcctcagcctcccaagtagcaggkattacaggcatctgccaccacgcccggctaatttttgtattcttagtagagacagggtttcaccatgttggccaggctggtcttgaactcctgactttgtgatccacccacctcggcctcccaaagtgctgggattacaggcataggcacacattatcttaataacaattgttgttaagatataataagatgaattatgaaatagtacataaatcacatagcatataataaaactgtgtatgataaagtactaaaattatgacagagcttacatacgtaaggaaataaatgtccagcacttagaacaggcagtaacaatatgtatataacattctaaagtttacaaagtcttccatacaccttatctcattttatcttctagcattcttacaaagcagatgacgtatcatccacattttacagcaaataaatgagacttggatgagttaaaatgacttagtcaaagtcacacatagcaaaaggaagagccaactaaaaaccaaaatttaaatcctgtgttctgccaggcatggtggctcatgtctgtaatcccagtactttgggaggctgaggtgcaaagatctcttgagcccagaagttcaagaccagcctgggcaatatagtaagatcctatttctacaacaaatcagaaaatgagtcaagtgcggtggtgcgtgactgcagtcccagctactcaggaggctgaggtaggaggagcctttgaggccaggaggcagaggctgcagtgagccatgattgtgccactgcactgtagcctagacaacagaacaagaccctgtctcaaataaataaataaataaaaatcctatgttcttccagagatatcacaaagctgtgggtccagaagagtaagaaggatggtggctgctggcttcacctgtggtgcaggcttggaattttccatcatcaaaggcacttgtttgttttgttttgttttgttttgaggcggagtctcgctctgtcaccaggctggagtgcagtggcaccatctcggcttactgcaacccccgcctcccgggttcaagtgattctcctgcctcagcctcctgggtagctgggactataggtgtgcaccaccacacccagctaatttttgtatttttagtagcgatggggtcccaccatgttggccaggatggtctcggtctcttgacctcatgatccacccaccttggcctcccaaagtgctgggattataggcgtgagccactgtgcctggccaaagccgcctgttttagggaccaatccttgtcctgctcagagctggaggtctgcctgtaggagcctaaactctcacaggcaatccctggctggtgagcttcttcagtgcaaggagcccatttttctctctgagacacatgcactttattctttcatgcctcagggcctttgcacatactgtttttttgtttgtttgttttttgagacagggtctcactctgtcacccaggctggagtgcggtggcacaatcacagttcactgcaacctccgcctcccaggctcgagtgatcctcccacctcactctcctgagttgctgggactacaggcctgcaccaccacacctggctaattttttgtattttagtagagatgcagtttcgccatgttggccaggatggtctcgaactcctgacctcaggtgatccatccgcctcagcctcccaaagtgctgggattacaggcatgagccaccacgcccarcctgcacatactatttatttccttcgcctacgacacagagaaacccagggcttccgaatagcatctctgcctcttcatcacactgaacctatctcctcacccttaaagtggccattctgacatcttgatgtcagscctctgagcccaagctaagcggtcttaacccctgtgacctgcacatatacatccagatggcctggagcaactgaagaaccacaagagatgacattccaccattgtgatttgttccttccccaccccaactaaccaatcgatcttgtgacattccacccccccaccaccgacaatgagtctcacgrtctccccaccctgcaccgtgtgacccccgcccctgcccacaagaaaacaaccccctttaactgtaattttccattacctacccaaatcctataaaactgccccaccctgatctccctttgctgactctctttgcagactcagcctgcctgcacccaggtgactaaaaagctttattactcacacaaagcctgttggtggggcggggcggggtggctcatgcctggaggccgaggtgggcggatcatgaggtcaggagatcgagaccatcctggctaacatagtgaaaccccgtctctactaaaattacaaaaattagccgggcgtggtggtgcatgcctgtaatcccagctactcgggaggttgaggcaggagaatcgcttgaacccgggaggcggaggtttcagtgagccaagatcacgccactgcactccagcctgggtaacagagcgagactccatctcaaaaaaaaaaaaaaaaaaagcctgttggtggactctctttacacagacgtgcgtgacaccaggctgctctgagaattccatgaattaatgaatgttgagtgcctggtacagagcctggcatacagtagacattcactaaatggtgacttatgaactctacacttcctccaaggaccaggacacatgcctcctcctccataaaatcttccttctcagtccacaggcagggatgagctccctcatactgtgtgttccttctgcaattttttttttttttgagaaggattttcattcttgttgcccaggctggggtgctatggcacggtcttggstyactgcaacctttgcctcccggattcaagcgattcttctgcctcagcctcctgagtagctgggagctacaggcgcccaccaccaagcctgggtaatttttgtatttttagtaaagacggtgttttaccacgttggccaggctggtctcgaactcctgccctcaggtgatccacccacctcggcctcccaaagtgctgggattacaggcgtgagctaccaagcccagctgcattttgtttaacatgataactcagctggttttttacataacagagacaaattctctttgacctttgtattcccgggtgtgggtgatggtaagtgctcagtaaacgtttatggatggcactaatgaaagtcctgcccatggccctgccttgtggcagtgtggaaagccaccacgtggccttctcagccttcaggacacagtggatctgtgaatcaggaactgcctgatggggtatgacccaaatcaggaacagaccgagwctcagggcctgaatcttagcaattgtcctcagtccttgggagagactaatttgagtttgattctttgcttccccagtgacatgcaagatgattttatctctccatgtggggcctgcaggcaagtcatgagagaggtaagcagcttctcttgctgtctggaatgcaaatatcttccctgtcgcaggctatgggagccamgccaagytgcaggcatggcaggcatggcaggcrtggagacacagctactgtcctgtttgcttggttggctgacttctaaggcctccctacgcttgcatgagtcactggaaattattccttcatttaacaaatacttaccgagtgagtgtctgctttgtgccaggccctgaggtagctctggggaggcacagggaaaagatgggccaggccctgccctcacagagctcataggctaatgcaggagacagatgataaacaaggagcaaaataaataaacaaacagtggcgtttctgagtcaagagggctatagaggaaaacaaaatgcagaaaaaaaaaaggagtccagtgacaaacgggcaaacaggggacactgcagattggggtcagcaaacaacagcccttgggccaaatccagcctgctgcttgtatttgtaaataaagttttatgggtatacagccatggccattcattcacctattgtccatagccactttgccctgacacagcagaggtgagccattacgacaaaggccacatggcctctaaacctaagatatttactgtctggtccttgacagaaaaaggtttgccaacccctgctttagatatccaggaaggccctctttttgagcatgacatttgagcagaaatataaataatgaggaaaaaaatgagacagacaaaggtcaaaaaaggagattcagaaccagcaagttcagacccttggtgaatttgagaagaggcaagaaggccacgagggctagagagctagggcctggtaggtggaaggaaagcaatgggattgaagtcagaggggtgggcagaggccagatcacatggggcctggccatggaacgaagggtacattttattccaagaataaaggaaactgaagtgtacacttttttttttttgagacggagtctcactctgtcacccaggctggagtgcagtggyagagtctcagctcactgcaacctccgcctccygggttcaagcaattctcctgcctcagcctcccgagtagctgggactacaggcgccagctaccatgcccggctaatttttgtatttttagtagagactgggtttcaccatgttggccaggatggtcttgaactcctgaccttgttatctgcccacctcggcctcccaaagtgctgggattacaggcgtgagccaccgcgcccagcctggagtgtacacttaaacatggttaaaatggcaaatcttacattatatatattttatcacattatatacattgggaaaaaagggaataaaggtaagccattggatattttcaagaagaaacttgaaggactttttataaaagtcctcttgatggaaggctgcaatttcttcaactctaaaaacaaaacggtaagccaggtatggtggctcagcctgtaatcccagcaattarggaggcagaggcaggaggatcgcttgggtccaggagttcgagacctgcctgggcaacatagcgagaccctgttctccacaaaaaaaaaaaaaaaggaataaaacaaaacaaaaaaatgaaaacgaagggatagtttagatcatgggttcttaatccaggctcaggggaaggttttcatgtttatatgtacgtttggggaaaggggaatgtcagtaactattgtggattctcaaagagatctgtgtcctctagagtcccaaaagattagagaatcccacaggccctgagctccagcataatatcaagagcccctcgaaatacggcatcttgtgggcatgatggcttacacctgtaagccctgcactttgggagactgaggcaggaggatcaccttagcccaggaattcaaaaccagcctgggccacatagtaaaacccggtcccttcaaacaatttaaaaattagcaaggcatagtgtgcacgcctgtggtcctagctgctccagaggctgaggtaggaggatcactagagcctaggaggtcaaggctgcagtgagctgtgatcaagccactgcactcctgcctgggtgacagagcgagatccggtctcaaaaataaatacatacctacagcatcttgtttaatcccctccccaagactgagtgaaatgcatgtcgttattcccatttcccagtgaccactctgaggctcagaggagtaaaatgacttactgaagggccccctgccaggcggtgacatatgggtatccatggcccatcaggctgactctgaagcccgtgctcctcacggctgcctctctgtctttgtggttctgtaagttggacaaaattattttcarccatggaggaaacataatggtactttggcatgtggatgctgcttgtaccgtgggagtttctgcttttggagttgtgttttgggagaaagggggttgttttagctttgtttttgtgccgtggggtttcaaagcatctggggatgcagacacttccatcttcctcctgcttcctgccaggagtgcaaatcagacacatttcccaaatccaaaaacawaccaccgggaaagcagtgaatttacacggtggaatttgtctcacttgagaggggcagaaatagctgccctgcacggtggaaatgtcgaaggtcatataaggaagccacaacagggcgccaagtccctggctcccaaggccccgacgtggtccaattgctcagtgctgttttctccaaacagattggatgttggcaaacgagagaaggcaaatgaaaaagctgaaggaggcaggggggaaactgaaaccaaatgcaaatgataagagatgaggcgttggggccagggacctgacacgtaaactcgccctcggctcaacttttgtctgtacctacccttaggcacagcctgtcaagcagaaaaatttccttccttaaaacattaattctaaaaaagccagaagattgagtgtgcccgggaataacttggtgattcagagagaagtgtggaagaacaggaggctgcagacctgagcagtcactggctaccaacataatcaataagaatggcatctattaattgaacacctactatgtgcatagagatgctttacatgaatcatctctgcatctcagaatacctggccagaaagagcttaggtctgttgaccccacctccagggctcttgtcatgacaccgctgctgattaacctcttgcctaccatcctgcattctcccatccctaaaaccattccatggaccaagacactgagtgagccccagaaagttatcattttcccaaggtcacacagcaaacaaacagtgctcctcatagtataggagaaagatcaagagacaaatttttctttgctgactttactctgctaagcctcagtttcctcatcagtaaaatgggcatcatgatagcacctacctcacagggtagattatgaaaccacgcatgtgcagtatctatgtggtgtggtttggctgtgtccccactcaaatctcatcttgaattgtagctcccataattcccacatgtcatgggagggacctggtgggaggcaattgaatcatgggggcgggtctttcccaygctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttattttwttttttttttgagaccgagtctcgctctatggccmaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggygtgcgccacaacacccggcctaaacctcttttctttataaattacccggtctcaagtatgtctttattagcagcttgagaacagactaatacactgagtatatgtagcaggcttgcagcttctcctggtgtgaggtgtaaaggggatactgaagggaagcgggtgttagttgtcatttgtcatagcagaaggaggttccaggggttagctgttgctcttataaagccctgggtgagtcttgaatggtgcctgttcacgatgtaccatgcactgttcagtttcacagcattctttcgtttcctcctccctgcagcactatgatccaggtacaattatggtcattccccttttacagatgagaaaatcaaggtaaagagaggaacattagacagtggcagagtcagactcagacccagtccgtctcagccccctcagccacgctgtgtctctcacgccagctttgcctcttttccagtttggcaccaactggcccgtgtacatgaccaagccggatggtacgtatattgtcatgacggtccaggagctgctgccctcctcctttgggcctgaggacctgcagaagacycagtgacagccagagaatgcccactgcctgtaacagccacctggagaayttcataaagatgtctcacagccctggggacacctgcccagtgsgccccagcccyacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaagcgtgtgtcttgctctgtctctatccttgcttgcagctcttaggagggacagcatgatttgtctttataggaagagctggactctttctgttcggagaggaaatgggtaccttggaaccatggaccttatggtgtggagagctgaggttttaggcaacttgccccagcgttctctaaacgggcagctcccctgggctggacctaactgccaataaccatcctagagtgtgtttttgtctcatcatagacctgagcaccaggagactccagagtataaagggtcaagcacggtttgtctagacagtgtaacaaagggttttctcagtagctactgtatgtcaggtaatttgtgtgcatcattttaagtttaacatgctccacagttctgtgaggagggtgtggagatgcccccttttcacagatgagagcactgggctttggagaagttgaataccctgctctaggacaatggcaaacctcagaacagaatccaggccccttaacccccactgtggtccggaaacattgcatgctttttgccatgcactgcgctaaggtgtgtgacatatatgaacccgttcagtcctcatttgtcaaactcaaaggttaattattagtgttctcaatttagaaataagcaactcgaagctcagagtgattgagttgctcacccaaagtcacacagctgatgtggcagaactggaatcagaactagatctgtctgggccgggcaaggtggctcacgcctgtaatcccagcactttgggaggccgaggagggcagatcacctgaggtcaggagtttgagaccagcctggccaacatagtgaaaccctgtctcttctaaaaaatacaaaaatcagccgggcgtggtggcaggtgcctgtaatcccaaccactcaggaggctgaggcaggagagtcatttaaacccaggaggtggaggttgcagtgagccgagattgtgccactgccctccagcctgggtgacagagtgagactccgtctcaaaaacaataacaacaaggattccaaggatttttttccattcccccataactgatgtctcaatttactgattatcttttatatgtcaaatattctaaatattgcagagaaaaacagcctctgcccttgaactcccagcctgacagattgagagaaagagaggtgtacacaggtctaatgcacaggagtgcacactgtgatccaggcagaaccaagtgtcaggtgggtgtgtcggggagcctgctgctgtctggagtgtgaggacagggagggactgtttctttcatgggtgcattggttatcacacatgcacaaaattaggaaggtcaggactgaataaggaaggagccagggtgggtgctctggagggggatgacagctccaggagccctcccaggaggagttggtcttggggctggctcattgggtggggtaagaatacagcttaggtttcctgttcccagggcaagcaagtacctaggggcacccaagtggacatcaccccttccctggaagccctttccaccctgatccagtgttgccacctgatgagaatggctttgccacaacacactcagacttatctgctggcatcttgggagcatcccagtcattccagcatggctatatgacacacaactccattctgcttttttttttttttattttattttttttgagatggagtctcactctgtcacccaggctgaagtgtagtggtgcaatctcggctcactgcaacctctgctgcccgggttcaagtgattctcctgcctgagcctcccaggtagctgggattacaggcacctgccaccgcacctggctaattttcgtagttttagtagagacggggttttaccatcttggccaggctggccttgaacacctgacctcatgatccacccgcctcggcctccctaagtgctaggattacaggtgcgagccaccacgcccggcctgactttctttagaaatggctttggtggctgagcacagtggctcacacctataatcccaacactgtgggaggctgaggtaagaggacctcttgaggtcaggaattcaagactagccaagtaaacagtgagattctgtctctaaaataaacaaataatataaatwaattaaataataaaataaactaaataaattaaattagcttggccttatgatgcttgcccgtggtcccagctacccaggaggctgaagcagacggatctcttgaggccaggagttcagggccacagtgggccatgattgcatcactgcactccagcctggacaacagagtgagatactgtctctaaaacaacaacaggccaggcacagtggctcacacctataatcctagcactttgggaggccgaggcaggtagatcactcctgacttgaggtcaggaattcgagaccagcctctccaacatagcaaaaccctgtccctactaaaaatacaaaaaatcagccaggcgtggtggtgcgtgcctgtaatcccagctactcaggaggctgaggcaggagaatcgcttgaacccaggaggcagaggttgcagtgagctgagattacgccactgcactccagcctgggcaacaaaagtgaagctccatcacaaaaaaataaaataaaataaaggcccagtgtttgaccctcagtaaattctccgtaaatcttggctgttaaccctcaacaagggtgataaattttgttttttttaaggatggatttgtttttgcaaaattttacagcctttttttttttttttttgtgagatagagtctccctctgttgcccaggcgggagtgcagtggcgtgatctcggctcactgcagcctctgcctccagggttcaagtgattctcctgcctcagcctcctgagtagctaggattacaaacgcccaccactacgcccatctaatttttgtatttttagtagagacggggtttcaccatgttggtcaggctggtctcgaactcctgacctcaagtgatctgcctgcctcagcctgccaaagtactgggattacaggggtgagccactgcatacagcctatacgttcttttcacaattttttttttaattattattatttttttgagacggagtctcactctgtcgcccaggctggagtgcaatggcatgatctcagctcactgcaagctccgcctcccgggttcacgccattctcctgcctcagcttcccaagtagctgggactacaagcgcccgccaccatgcccgggtaattttttgtattttcagtagagacggggtttcaccgtgttagccaggatagtctcgatctccttacctcgtgatccgcccgcctcagcctcccaaagtgctggaattacaggcatgagccaccacgcccagcctcttttcacaattatctatcggtgcttactgctgagaccagttcccagggacacagcagtaagcgaggcaaagtctttgccctcacagagctcctagtttatcagtgggaaaatgagatctacatgattatagtacttcatgacaagtgaagaaagccctggcagcaagcagcagaaagagcagaacttggctgggcacagtggctcatgcctgtaattccagcattttaggaggctgaggcaggcggatctcttgagtccaggagttcaagaccagcctgggcaacatggtggaaccccatctctacaaaaagtttaaaaaattaggccagccatggtggctcacgcctgtaatcccagcactttgggaggccaaggcgggtgggtcacgaggtcagaagttcgagaccagcctgaccaacatggtgaaaccccatctctactaaaaatacaaaaattagccaggtgtggtggcacatcctgtaatcccagttactcaggaggctgaggcagaagaatcgcttgaacccaggaggcacaggttgcagtgagccgagatcatgccactgtagtccagcctgagcgacagagcgagactctgtctccaaataaataaataaataaattttaaaaattagcagggtgtggtggcaggcacgtgtaatcccagcttctcaggagactgccatgagaggatcacttgagcccgtgaggtggaagatgcagtgagccgagattgcaccactgtactccagtctggatgacagagccagaccctgtctcaaaaaaaaaaaaaaaagaaagaaagagaaaacaaagaataaaacttgccttcatgcaagaccacccggaggagaggatgttttagtcagagcagagaagtgtcatccagtaagagaatggggtttggagaagggtaaaatatgagactgatggaaggactaagcctagtatccttatactatgtggaaacaatctatggaaggcgattctcaaaggattctagagattcttcaacaatggcctcttggaagaacaatactcatttgcctggagagaggcaataaaagcattttcactttgcagccccattgtacagaacacagcgcggaggacatgcgttttcggagcagtcccattgtgcagaatgcagtgctgaggacatgtgttttcggagcagctcatgttcttttttttttttttttttttttttttttgagacggagtttcactcttgttgcccaggctggagtgcagtggcgtgatctcggctcaccgcaacctccgcctcccaagttcaagcgattctcctgcctcagcctcccgagtagctgggattacaggcatgtgccaccacgcatggctaattttgtatttttagtagagacggggtttctccatggtggtcaggctggtctccaacccccgacctcaggtgatccgcccaccttggcctcccgaagtgctgggattacaggggtgagccactgcgcccagcctgtgtttaatattttgtatatggtgatatgagcacgggaacagatgtgataggaatgcccaatctgtaaacacagtttttgatgggtacaggaaagaggcgttaagaagattaaattgttaggctgggcatggtggctcacacctataataccaatactctgggaggccgaggtggacggatcacctgaagtcaggagttcaagaccagcctgcccaacatgacaaaacccagtctgtactaaaaagacacaaaaattagccaggtgtggtggcacacgcctgtaatcccagctactcaggaggctgaggctggagaatcacttgaacccaggaggcagaagttgcagtgaactgagatcacaccactgcactccagcctgggtgacagagtgagactccatctcagaaaaaaaaaaaaaaaaaaggaaaactctatgactgaatagaaaactatatggcataatggtgacattagttatctattgctgtatagcaagttactccaacatttagtggcggaggacaacaaatacttatcatctcacagtctctgtggggcaggattctgggctgagccagcttctatggctcgaggtctcttacaaagtggcaatgaatatgtcaggaagggcttcrgtctcatcggaagatttgactgggggtggatccacttcaaagctcactcagtttctggcaggattcagttcactgtgggctgttgctgttactattcagttccttgctatgtgggcctctccacagggcagtttacaacctggaagctcacttctcttagaacaagcaagcaagacagaaaccagagtctttggaatgtcatgaaagtgacagtccatcacttttgacaaatttagtccacagaagcaaggcattaacatccagcccacaatccagaggaggggataatatatatggcataaatgccaggaggtgggtattctaaagatgtaaaaattcacaatgtacatgaacaaggaaaacaaaataaaattaaaaagtagataagcatggtggaagggtcagaagatgcaggcctggttagccctgttaaggagtttgactttattccaaagggcagccatcagtttcaggtgtgggtcacgtgg

SEQ ID NO: 12386 - DNA, 76344 bp, Homo sapiens
  misc_feature (1)...(76344): n = A,T,C or G, or insertion/deletion polymorphism (see Tables 1-2)
caaagtaggcactcaataagtatgtgctgattgaatgaatgaaggtgacttgaaatagaggcaccagcatggcctttggagctagaactgggcaccactcccatctctcccacttcccatgtgtcctctgcaccacatgcatcaacttcctagcccagctgaacaagagccagactttctagatttgaatcctgactctactacttcctagttatgtggtcttgggcaagttccatcagtttcctcatctataaaatgggaattgtagtagtttgtatacttcatagggatgtgtggcatgttgtaagtgcttatgaattatctgggcttgatttcccagctctttaaagagaatattacttgcaaggttgttgtgagacttgaccctccataaatagcagttatcatgattccatttgataatactttctatgatctaatcacaactttatgaaatagggaaagcatccctattttgttaaaaaaaaaaaaaaaaacaaactaatgtgtaaattgagtgatacattcgagttcaacactagcaaggatagggtctaactcagacacaaacacatctctccagacccaagactgtgacccttttccccgcatcacaaattcctttacaggtctgaaaaggccccctgttaaactgaagatgttcttgggaaggactgcactgtaagctttactcttttaaagaaagacaccatacggcagtagtttttaacatactgtgcagcagaagcacatggaaaaattgttaaaaacaggttattggctgggtgtggtggctcacgcctgtaatcccagcactttgggaggccgaggcgggtggatcacaatgtcaggagttcgagaccagcctgaccaacatgatgaaaccccgtctctactaaaaatgcaaaaattagaatggcatggtggcatgtgcctgtaatcccagctactcaggaggctgaggcaggagaatcgcttgaacccaggtggcggaggttgcagtgagccgagactatgccattgcacttcagcctggccaacagagcgagactccatgtcaaaaaaaaaaaagaagttactggccccacccctggaatttcggattcagtatgtatgggttgagctggaaaatcttgagaaccactcccctaaggggaagtagctgaaagctggcttagaaagcaggaaatggtgtgggcaggagagatctggggaaagccagggaggcaggaaggggcagctttaagagccagccagagaggggagggctctgccagatggaagaaaaagcaccagatcaggctctagctcaatctcagtctttggcaaatcaccttttctgagataaaaaggagtaattcttttaaaaacaagctaccacagctcaccccatacgaaataatttgagtacccctgtaactgtttcaaaaatcgaattaatggccgggtgtggtggctcacacctgtaatcccagcactttgggaggctgaggcgggaggatcatgaggtcaggcattcgagacccacgcggcaacatagtgaaaccccgtctactaaaaatacaaaaaattagctgggtgtggtggcggacacctgtaatcccaactactcaggaggctgaggcaggagaattgcttgaacctgggaggcggaggttgcagggaacagagatcgtgccattgcaccccagcctgtgtgccactgtgagactccgtctcaaaaaaaaaaaaaaaaaaaaaaaaattttaaacttccaaaaaaaatcttcagggcccagatagtttcactggagaattctaccaaaagtgtaaagaacaccaaatatatacagtctttttcagaatacatggtgggggaacatttcccgattcattttatgaaccctgacaccaaaaccagacaaagacagttttaaagaaagaaaactgcagaccaacatgtcccaaaaatacagacatagaaattcttattaaaatattagtaaatggaaatctgcaatatatagaaagaattgtataccatgagcaagtgggatgcagtatttgaaaacaatgtgctccaacatattcacaggcagtggtggtgaccgcaaagggactccactgagcagtaatcaatggcctgggatgaaagtggggccaaacaaatctggggaagcagaaaaattagattctatacacatggcttttgttcaaacaaaataaagctctgtactccacacaaatgtggtggctgttaggttctacacctaatgcttgacagaaagaaggggccaccggaagtgcagggacaaacaggagcaaggttatcttgaggctccaggtgctaagagggacagtccaagcagaaaacccattccccaaagtcactgccatccctagagcagggttcaggggcagagaaggacaggagaccctccagtcaagaagttggcggccaaaagctgagaaaacccatcctggaatttttgcttaggggctctgagtttaaactttgaaccacatccttataaatttgtatttgaatttggaaacactgacctgacaccttttaaaacataccaaatgtagagagagagtttgatggctaatcaagttcatctctgtatgaagtacttgaactagcaaaccctctgtctgggacatatctcccacaatggaaaggctcccggctgcctctgctgttcaggacagtaaggattttggctctctgccttgcccacatggccacggcactcaccattctgagtcctagtccaagctgacagcgtcttcctgtcctactgagataaagctccagctgaaagcttgctcttgctctgaaatctgcagaagtcctggggagttcatctcctgggaccagcccttagtcaatgaaggatgccagtcagaggataaaaaccccagggttcatgccagtgggagggatggctggggctgttcttcacaaactgtaatgtgcccctgaatcacctaggaatcttaataaaatttagactctaattcagtaggtctgagttggagcctgaaattctgcatttataattttttcttttcttttcttttcgagacagggtctcactgtgtcactcagactgaagtgcagtggcccaatcatggctcactgcagcctcgacctcctgggctcaagcaatcctcccacctcagcctcccaaagtagctgggaccacaggcatatgctacctttcctggctaatttttaaattttttttttttttttatagagacaaggtctctctatgttactcgggctggtctcaaactcctaggatgaagtgatcctcctgcctcagcatcccaaagtgctgggattataagcatgagccaacactcccggcctgagattctgcatttctaagaggatcctaggtgaggctgaggctgcttacctggggactacactttgatgcccctaccagtgctttctgcaatttcctcccaaataaactgtctgctctcaaattcttgtcagaggctctgtttctggagaaagcatttttttttctacctctctacttatattccaggttccttgttctcagttttcacaaaacccagccactaccttacaatgtgagccaaggaaatcacttcatttcctcatctctagaataagagtttagactgtccagttccccttcccactccagcattttaaagattttctcgttattctagtgattgtggaacttcccacacttttttggatcagctttcctgctcctgtgtacaaacttttaaaatcaagctggcttcacattctgcttatcttcaaaaatgtctctaaacacaaatgaaactcgaccttttattcaagcataatagtaaaaatctttgacaccagagagaaatggaggtaacaaatgttcatgcatgcagatkacattttcattgtaaaaggaagaaagggaccattcagaaaaacacaagaatagtaaaatgaaaattagtatgaaaccaacaaaagatatgaaaccataatctgaagacatctaaacaggagataataaagataagaaaacacagcagtgaatttgtgtaccatgtctgcttttaaagcaacatctctagacaaacacacaaatatacacatgctgtccccttcaagaaaatcattttggaaacccatcctcttacacttatgcgtaaacatttttgaaatttcttcttctttttctttttttttttttttttttttttttgagactcaagctcactgcaacctctgcctttttggctcaagtgatcctcctgcctcagcctcctgagtagctgggaccacagggacacaccaccacgcccaactaattcttgtatttttggtagagagagggtttcaccatgttgctcaggctggtcttgaactcctgagctcaagcaatttacctaacctcagcctcccaaagtgctgggattataggcatgagccactgcgcctggcctaagtttctttagtttataagaaaccaagtatacaaccatacacataattcaatatcaccactttagtcaccactttttacccaaaataatacaacccagcctaaatgcaaactttatttccagtaatttaataaacttcccaaatattaatacagttcactcatgtaactgtcagctattgctgcataacagacaacccccaaaatcacagtggcacacaacaataagtagttatgtctcactcaagagtcttcatgtctgctgggttgctctgcttcaggctgtgagtcctccggctggctgagatgcctctgcaatacgtgaattcagtctggtacccagatgctaataggcagctacttgacctcatggcagaggtcagatgttcctgagaacagaaacacggtgcttctaaaggcaagactggtggtacactgctatctctccacattccattcttaagcaagccacatggccaagtccaaggtcaataaatgactctcacagagttattggtagatggagtgaatatatgataatctatcaattcctaaattatgatttctcaatacagaagtcattaaaaagaaggcattttccaaggaggagtgccaaaagcgatgtaataacgttatcattgaaataagtgtatagctacataatgggaccatcttggatgcacaagtttttgtttgcttttaaaagttattttaatgccttttatataagtcagacttcatgcttgcctcagtgaaaacatgcaattcctatttatgattggattgtcctgaaacctatacacagaggctcctaaaagctatcaagtcaacatttccttatttcttcactttcatttaaaaaaaaatcttttaaaaaggaaagaaaaataccagaatctccattctgatgtcgccatgctgaggcttggcaagccaaaaatataaggatgaaaaggcaccaccaattcgtgagagtcggctaggcttcttcgtgctattccggacagtcaggagccctgggttccagccaggtgatcgggtcgcttatcggctcctatcacctcagctgcttgctccacttctccgggtttccagttctccatcgtaaatgtgctccctggagcagcctcccctgacagtcagacatccaccaatccattagatgctggaggttttctggagacactgtttccctaatgaggactgctttgtacagtcactgatagcagctctagaaagtgtaacagcttttttatgtcaaaagctgttcctcgcgctccggctctcggggagccgccttccagacctgtctacccgggagccccctccccgcgcacttcccagacttctcctgagacccgagagcgctggttttcccccactcgcgatagtcctgggatgacagtgcgggccccctcactcgcagctcccaccacctggcggccaggggttcgcggcccgggcgggcggcgccagtgccctctggagctgggcggggagggcggggcgggcggagcgggcatggtggggtgtcgggggccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcgggtaggcgggcgccggggctgcggggaggcgcgggaccggggctgcgggagcggcggcggctgggggctggggggggtaggaaggcgaggaaggtacttgcggagagctgaaccctgcgcagccagggataggggtgttgcaacagtgcgcccgcgctgggcatggccgagaccggtggttcccaaatgtgtggctctcgggactccttcattccattaaacaagtgaggagcccagagagcttctgcggggttttttgtttgtttgtttgttgttgttgttgttgagctctctcccgggctggagagcggtggcgccatcagaggtcgctgcagcctcgacctcctgagctaaagcgatcctcccacctcagcctccagagtaactaggaccacagacgcacgccaccaggcccagctgactttgggagttttgttttgttttgcttttgtagagatggggtctcactatgttgcccaggctggtctcaaacgcctggactcaagtgatcctgaagtgttgggaggccccagcctcccaaagtgttgggattacaggcatgagccaccgcacccaggcagcttttgtttatgtaggctatttatatcacatttaccgtaatggaaatttaaaatttttaattatttttaaaaaagaaatggactacattgttagcataacatttttaattaagaaataactattttccacaagaacaaaagtgtagcgagaggagtggtgataaaggttacatcctggcgagtctctctaaggtctggctagtggaggattgctgacttctcatacctgcttctgcattcaccctgctgctaccacacccttatgtagtctctggaaaactccactgtgttcttgtgacagaatgacagtaaaaatggcaaaaacatttattaaggactgaattatatcccccacaccacccaccgaaatttatacactgaagtcctaacccctggtgtgactctatttggagtgaagaattaaggctaatgaggtcataagagtggaatcctggtcccatacaattaatgtccttataagaagagacactggagagcttctctctgccatgtgaggccacagcaggaagacagccatccacaggccaggaagagagccctcactaggacctacaatgggcaagcacctcgatttggaacttccctgcctccacaattgtgagaaatcaatgattcgtttaagccttttttttttttaacaggatttgagattggttatattaacaatggaaacatgaatacaaaattaatccacacataggaaaaaagaataatacataaaccactgaggttgctaataataatgatgcctgtttccaaggcaactgaatacattatgagaccactgaagtgacttttagttaccttgcttagtgcctctgtcttgtgatggagaaacaatggcccacctgcaattgtcatcatttctatgacctgacatctttggaaaccatggaaagatccaattgacaatcaattactctataccttaatagttacattactattagtagtataatattaataactgataatgttactaatattaagaaaacctgtatgataaagttggtttgggcaacatgaataacgcctgtgttaaacactttatggtgacctgaggcaccacataagcaggggacattatttagccaaggtgtaactgaatctgtgtagtaatataaaactgatttctctgggattttctcagagttttttataggccagcattatctctttagccacattactgcaatcccagtcatggcccccaaggcatttctatgacccctaggcactgctggattccaaaatgtcttctcaatatttaaagaaagatgaaatattctcactatccttacttctgtcagtggccccattatttttccagtcccttaagtctaaagtcttgaagctatctgagtaatcctctatctcacacgtccatgtattattttggaacatctcacacacayggttttttatttgtgaatcttttccagggtttactatctctggagtggcacccaactcatctagttgagcaagtcaaaagtctaggagtcatccttgatatytctstctccaccttacttctcacttcacatactctatgcatggagcaagtcctatcagtgttaccccctaaaggagtctctgaaatccaagcactttgctgcacccccattgcgamcatctactccaagctatcatcatgtttcatgcagacttcagcagtgatttccaaactcatctccattcattctggtctcctctccacactgcttctaaagtaatctttgaagatgctaatctgattgatcatgtcatatgttttgttcatttttccctttcttttcttcaccaagggctttaaggatttttctaagatgttcaagtgcttcctactaaaaaatctcccacagataataattataaactctgggcaaaacactaaataaaagagacttaaggcaggtgaaaagtgaacaaaagtaggcttataacacttgaaagttaacacatgaaagaacaaagtggtgttggctttttctgtgtttgttttataaatgacttgaagcctgaaagaaaatgccagtctgctcccagctatagttctgatggaaaacccacaggcttgctggtttgaagagcccaaagacagggtttgggaaaagcacagctactgaatgaaatacaaaagggaaagttccagaaaggaaagagccagagagacagagccctaaaatctatctataatcttttcccagatatctggcaaatcttgaatcatgtatacataggacagactccaaacctcctggttgaggccaaaagaactgaaaatagttgtgcccatctctaggtagacagattatagttttggtttggtcaggttaactgcttgctttaaaaaacaaaaccaaaaacaaaaccaacacttttcagagaaacacagtttctacaatggatcactcacaatggctaggatattatccaaaattacttgaaatacagagggaaacatgatttattcttaagagaaaagatgatcaatggagattcatccctagacaaccctgatgctggaattaagcttcaaggattttaaagcagctagtataactgtgctcaataatataattaaaaatatgataataaagattgctgtaatcccagcactttgggaggctgaggcaggtggatcacttgaggtcaggagttcaagaccagcctggtcaacatgatgaaaccctgtctactaaaaatacaaaaattagccgggtgttgtggcaggtgcttttaatcccagctacacaggaggctgaggcaggagaatcacttgaatctgggaggtggagattgcagtgagccgagattgtaccactgcactccagccagtgctggagtctcatttgagaatgagactccatctcaaaagaaaaagaaaaagaagaaaaagatttaaaagacagtacatttctgcagagtaatagaaactattttttaaaagccaaatggtaattccagaactgaaaaatacagtgtctaaaataacaaactcaatggctaggcttaacagcagaatggacatggctgagaaaagagttagtaaatgcaaaaatacatcaatataaattatccaatctaagaacagaaaaaaatgaattttaaaaataaagtgtggccaggtacaatggctcatgcctataatcctagcactttgggaggctcaggtaggaggatgrtttgagcccaggaacttgagaccagcctgggcaacatagagagatcctgtctctaccaaaaaaagaaaatgttaaaattagccaggcatggtagcatgtacctgtagtcccagctactcaggaggctgaggtgtgaggatgacttgagcctgggaggtcgaggctgcagtgagccatgattgcaccactgtactccagcctgggtaacagagcaagaccctgtctcaaaaaaaaaaaaaaaaatacataaataaaataaagtgtcagagatttgtggaaaaataaaacataaacataattagagttccaaatatggtgaaagacatacaattacagattcaaggtcatagaacatcaagaaaaactaatacaggctgggcctggtggctcacacctgtaatcccagyactttgggaggctgaggcaggcaaatcacctgaggtcagaagttcaagaccagcctggccaacatggtgaaatcccatctttactaaaaatacaaaaattagctgggcatggtggcgcacgcctgtattcccagctactcaggaggctgagcaggagaatctcttgaacccaggaggcggaggttgcagtgagccaagattgtgccaccacactccagcctggatgacagagtgagactctgtctccaatttaaaaaaagaaagaaagaaaaactaatacaaagaatacatccaggcatatcatagtcaaactatgatgaagagaaaatcttgaatgcagccagactgaaacaccgtatataggagaacaacaattagaattaccactgacctcatcagaaacagtggagaccagaaggcagtgcaacaatatcttgaagaataataattacaaaaactttgaaccaagagcttcaaggccctgtgcatagcctgtcctcagccttcactcyagcctcatctcacccactctccctcctactctctgcattgcagtcaccaggacctttgtagtcactgttccctctgctcagcaggccttcccctcctctgccctccagccttcctggataccccacctagtgtattatctcagttactgactgtcataaaatccctgttttcttcagagcacttagtccattttgtcattatgtatctgtattagtccattttcatgctgctgataaagacatatctgagactgggtaatttataaagaaaaagagatttaayggactcacagttccatgtgggtggggaagcctcacaatcatggtggaaggtggaaggcacttcttatatggcggtggcaggagagaaaatgagaaccaagcacaaggggtttccccttataaaaccatcacatctcgtgaggcttattcactattatgagaatagcacaggaaagacctgcccccatgattcaattatctcccaccggttccttcccacaacatgtgggaattatgggagctacaactcaagatgaggtttgggtggggacacagccaaaccatatcaatatccatttaattaacctctagctcatccactagactccatgagagcaggggtcctggctgtttcccattgccagcaccttacgcagaggctgccttatataaaataaaacaagtgttcaatcaatatctgctgaaggaaggaagaaatgaaggaaggttaccactatttttatcagtcatcatttcgtacctacttacaatcacttagcttctctttgttctcccaggaaatcagaaacagctttagggttttccacttctgctggtatgaagggcaatcaaaatcaagaaccagaacaagccagtcctgtgagttcatgtcatctaattgacactcgtttaaaaacacagcacgcatgtaatgacatgtgaagccaggaccctatggtggtccccatattttttttccttttagtttaatgacccttgaaaatcaatggtataaatcatgattattgagctcctgaaacccatatttagccacgtccttctctgggagtgttctctggtttgtctaacctactctttcctgaaagttcctattgcttctatagtcaaaatcactatttagaacaatgcatttaatctttctaagcctaaattttcttatttataaaagggagctaataatagtaccaacttcatgtaatcgacatgcttaaatgactagtccagtgcctgatcaataataaatgcttaataaaaagtaactgtcatgattttattactttttgatcccttaagaaatctagtatagtgctacatatacagaatagatacccaatataaacaataaaagtttaatttttttactggttactgcattttagttatcatttaagtcattcaaaattgataactcagccgggcatggtggctcacacctgtaattccagtgctttgaggggccaaggcaggaggatcacttgagtccaggagtttgggaccagcttgggcaaaatcatgagaccctgtctccacaaaaaatattttaaacaattttttaaaagttagctagctgtggtggcacatgcctatagtcccagctacttgggaggctgaggcaagatcacttgagcccaggagttcgacgctggagtgagctatgctcgtgccactgcactccagcctaggtgatacagacctcgtctcttaaaaaaaaaaaaaaaaaaaagatactcaagatactcatgttggtatacattataacactttattactaagaattaataacctcaacatcccattccctcatgtcaagtaactggaatgaatgtttattaagtattctttaatcaatgatttaagcatatatttgcaaggtttcagcagttccctggaaaacttaagctctaaaagggtactgactatggctggatctctaagtgccacagagtggactgcttaaaagatagagctcatgcctgtaatcccagcactttgggaggctgaggcaggcagatcacgaggtcaggagatcgagaccatcctggctaacatggtgaaaccccatctctactaaaaatacaaaaaattagctgggcatggtggtgcacacctgtagtcccagctactcaggaggctgaggcaggagaattgcttgaacccaggaggtggaggttgaaatgagccaagatcacaccattgcactccagcctgggtgacagtgagactctatctgaaaaaagaaaaaaaaaaaaaaaaaaaaaaatggaactcatccaactcagtgtctggaaatcagcaagaacttaacaaatgtttggtgcattgaattaagttgagtccaccttgagcattcctagagtccgattcttccattttcccttccttgaacatttgaatgtccaattttctgcagaattagatcctagacaggaatgtgttaaatacgtgcgcagtggggtatctctcatgtcttcttacctaggactatcaattaatacatatgtagttataatgatccagtacgcacaaggaagacaaattcagtgtaattcactcttttcttcatcatgtggcaccaggactgaagtctccaaaactaaaatgaggtcaaaagttcttataaagccaatataatctgtttggctttcaattgtgtttctcaaaatcaaatctggcagaagcacatgtcaaaatcttccccacagagtataaattctggtgttttttatgtaaagcaaaaccaacaataaaaaaaaaatctgagcaaattacgtgcagacatagaacatggaaataactaagcttcttcctgaactctcccaccctactcaatactcctccttcaaggtaattaatgtatactgaatttggcataaatttggtaataataaaataaatattgactaaatatctactgtgtgcccatctctctttctctgatacccagagaagatcctctttgatttgggatgactcggggtttcccataccgctcaagtgcttacggtggttaaatcatttaaacagattctgctactggttatgtgggcaagtggctacacctgtgatgctttgattttaaaacaagaaggatagtacctgataaaatatttaaagtcagcaccaacttactaaaattgctatttcaatagctagatttgcaggatcttggtattaaatttcaaatacaagaccatgtaagttaaaaattaggataaaaagtgcagtaattaccatacattagaaatataactcacagagcaaagaagcttgtaatgagccagttgatccagaaagtgtaggcacagtggtgctataatgaatgagggatgggtgactaaaatcaatgcacttacatttcattcctttcccttatactgaaatattctcatatcaccactaaagcagcacatttttatgtattttttgaagctgagaaacatgctggagtttcctgcgttacagcctcagtggatgacatacagtttgaggagacagctaggtaagtgacattgctccatggctcctttctcctgggtttgtgggttcatctgggacatgtattggtggcacctgagcttattcaggcagaggtagtgatcttgtttcttaataaaataaataacatgtgacccaatttaggtaagtaaaaaaataatcatagggcctacttataagaaacactcttaagtgtaacttcacagtctcaattttgtggagaaatagctctcagccttagatgcattgtggcataaggcataacagccaaacagactttctataagctcctttttttaattgtctcactctgctgcccagactggagtgcagtagtgtgatcttggctcactgcaacctattcctcctgggctcaagtgatcctcctgcctcagcctcccaagtagctgggactacaggcacatgccaccatgcccacctggctaattttttttgtatttatttatttatttatttttagagatggggtttcatcatcttgtccaggctgatttcgaactcctgggctcaagcgatccacccactggcttcccaaggtgctgggattacaggagtgagccaccatgcccggctactataagctaattattaacatccccttcctgtactagaagaataattaatgataataagtatctttataatggtgaatttcatcaggttgttaggtaaacactaattcatctgagtagagagagtaaattatgaaaaacattttatgtgtgaaagttcttaaccatcttttactgtagaaaatttcaagatacacaaacatttcaaacatacatatttaggttggtaattgagaaaactgcgattacttttccaccagcctataaaacaagagaggatagtacagtgtatcgcaaggacccttcacccctagctatagcaattatcaactcacagacactcttgctttatcaatacctctccacactcccccatatgcctggattgttttgaggaaaaccccaagcatcatctgtaaatgtttcmgtctatacagtcatgcatcacttaatgacgggatatgttctgagaaatgcatcactaacgacttcatccttgtaggaacatcatagagtgtacttacacaaacctcaacagtacagcctcttacacacctaggctatgtggtatagcctattgctcctaggctacaaacttgtgcagcctgttactgtactgaaaactgtaggcaattataataacatggtgactatttgtgtatctaaacatagttaaacattaaaaagatacagtaaaatacagtataaaagatgaaaaaatggtacacctggccaggygtggtggctcacacctgtaatcccagcactttgggaggcctaggggggtggatcacctgaggtcagcagttcaaaaccagcctggccaacatgaaacccygtctattttgtactaattttgtactaaaagtacaaaaattagccagttgtgatgacgggcgcttgtaatcccagttactcaggaggctaaggcaggagaatagcttgaacctgggaggcagaggttgcagtgagccaagatcacgccaatacactccagcagcctgggcgacaagagcaagactctatctacaaaaaaaaaaaaaaaaaaaaagtacacctatgtagggcacttaaccatgaatggagcttggaaggctggaagttgctctgcaggagtgcaggagtcagtgagtgctgagcaaatatgaaggccccagacattactgtacactaccttagaatttataaataccacacacttaggctacaccaaatttataaaaatatttttctttctttaattatgaattaaccttagattattgtaacttttttactctataaacttaaaaaaatctttttgattcttttgtaataatactgagcttaaaacacaagccttttatagagctgtttaaaaatatttttctttatgtccttaccttattctataagctattttctgtttttaaaatttgttattttttttttttaccttttaaacttttttattaaacacaatgacacaaacacatacattaccttaggcctacacagggtcaggatcaccagtatcactgttctgcttccacatcctgtcttactagaaggtcttatgggatttattaaaccaggattcagtataggtgataggtctcttaagtgtcttttaacataaaatgttcccttccttcttttrtctygcaatttattttttaaagaaacctggtcatttgttttatagaatttacatccactgtagccttgattaatgtgttctcctgtcctttgtatttcttgtaatctgacagttacatctaaaaattgacatgatgaaggtttgattttgttttttctttgagatggagtcttgttctgtcacccaggctggagtgcaktggtgcgatcttgactcactgcaacccaggttcaagcgattgtcctgcctcagcctcccgagtagctgggactacagggcagctgccaccatgccctgataatgtttgtatttttattagagacagggttttgccatgttggccaggctggtctcaaactcctgacctcaggtgatccacagtgctgggattacatgcgcctgccaccacgcccggctggtgagggtttgatattcggtaaaaatttctcatgtcaaggccatatgatatctaatgatcatagactacaaccattctgtcattagatattggaaacatggtaatatgctaattctatcatttcttcttcatttattttctaaaatacttctctagagggaaactctcactaatgacctgagtatcctgaggaaaagtttgttcaggaaagtcttgactctttccctttattcattaagagcctatggattttcatgtacttgatgtgttacaattcatccatgttattcttcttctttttttttttttgagacagagttttactgttgtcacccaggctggagtgcgatggcgcaatctcagctcactgcaacctccgcctcccaggttcaagcgattctcctgcctcagcctcccgaagtagctgggattacaggggcctgccacaacacccagctaattttttttgtattttttagtagagatggggtttcatcatgttggccaggctggtctcaaactcctgatctcaggtgatccacccacctcggcctcccaaagtgctgggattacaggcatgagccactgcgcctgggcaatgttattattcttacagaagttcagactgccccatctttgagcagtgggagcttcttcagtttaatccctaagtcccttgaacaaaagcccaaagttaaaggtgcttaataactccttggccttctggtataaaatgtttcagtctcatcttttacattttcccccacaaacttagaatccattatttctccaaggagtcctgattccttgcagtagaaatgagaagtagagaccacaacctgggcaggaaaggtgcacatcacatcaaaatgggcattcgttctcggccttttcagcggacagaattagaaattatgtatttttaaagcatttaaattaataaactgcaataatttagggttatatggttttacttaatttctttgattttatgtctatatctctgagttttaattttattttatgctgaatatcatgatatttaaagacataaacttatttgattgaaattaatatgtatatacacattaattagattcagaataacagtaccaatattatcactaacaaatgaatagagaaagtagcttaagattatttatgcagtttctttctcaaactgtatctcatctggtacagccaagtcactgtattttgaagtcatttgaaataatcattttccatgtggttaagctactgacttcatacattcttaagttcatttgtttaatttgctttttattttgtaggaatgacttttattttcatttaattttgttttatagtttaaaatatctacaggtaccagagtcaaatctggaaaacagacccatttcaccctggggaaactggctcctccctaccttctgtctaggcccctccctctctttctatgtaagctttatttattttgtgctgtatccttcttttttttaatgtaaagaaatatttatatgtatccatgttattttaaaaataaatttcaacacactgtgtgtactcttctccacctcacttctttcacttaaaaatgaggtggagaaaagtatatatagtatataaaatatacactgtaaaatatgtagtatttccatctagaaaatcactccataccaatatgcagttatgtgctgcatagcagcattttggtcagtgacagtggtcccataagattttaatactggccgggtgcaggggctcacgcctgtaatccctgcactttggaaggctgaggtgggtggatcatctgaggtcaggaattttgagaccagcctggccaacatgatgaaaccccatctctactaaaaatagaaaaaattagctgggtgtggtggcacgcgcctgtaatcccagctattcgggaagctgaggcaggagaatcacttgaacctgagaggcggaggttgcagtgagccaagattgcaccactgcactccagcctgggcaacgagagcaaaaccccatctctaaaaaaaaaaaaaagrttttaatactgcatttttactgcatcttttctacatttagctatgtttggatacacaaatacttaccattgtgttacggttacctacagtattcagcacaataacatcctctacaggtttgtagcctaggagcaataggctataccgtatagcctaggtgtgtaggaggctataccatctagattagtgtgggtacactctatgatgtttccacaacaacaaaatcacctaatgaagcatttctcagaacacacccctgtcattaaactaggcataactgtaagtagatattcatcattccttttagtatctacatagtactccattgtggagacgcactacattwttcaactggccctccactgatgaacatttatattgtttccagtcttttgctattacaaataatatttcaatttgtagtcttgtgcagatgtatgtttgtttgtattttttccagtatatttgtgggatagatttcttttttttttttttttttttttctaagacagtctcactctgtcacccaggctgaagtgcaatggcacgatctcggctcactgcaacctctgcctcccaggttcaagcgattctcctgcctcagcctcccgagtagctgagattacaggcacgtgccaccacacacagctaatttttgaatttttagtagagacagggctttgccatgttggccaggctggtctcaaactcctgacctcaggtgatccacctgcctcaccctcccaaagtgctgggattacaggtgtgagccaccatgcctggcctttgtgggatagatttctagaaataggattgctgagtcaaagggtaaatgcatatgtcattttattaaacattgccaaattcctctccagagcagttgttatgtaggttttatcagttttcaaacttataaaattaagggttaataaaactgtgccagaaatttaaatttgttcagatttctaatataggaattaattgcttaaataaatatacatatgtatgtattattaaactctttacctccagtttttctgccaaaaaatgctacagattatgacaggtatgtagagtaacaatatgtgtgcaaaggctttaaccagatgcagtcactcttctaggtaaacccaactggttcatcttgtagactgtctttaatatatctgggccagatgcactggctcatgctgtatcccagcactttgggagtccaacgcaggaagatcgcttgaccccaggaatttaaggctccagtgagccatgattgaaccactgcactctagcctgggtgacagagtgagatatgtatatctgaacaagcctctctactatgattaaaatagtatgaattgcaattatttaccagaaacctgagtagggtaatgttgtcaaagctttggagccagataagaccagggtttgaactctgatcctgccagtcactatgtcaccttctaaggccgtttcctgatgggaatgaaatgggaatgataatgcccacctcatggggttactgctcagtgaatgacrtgttgttagattatgatacaaagcgtttagcatggtgcttttttttttattattattgtactttaagttctggggtacatgtgcagaacgtgcaggtttgttacataggtatacacgtgccatggtggtttgctgcacccatcaacccattatcaacattaggtatttctcctaatactatccctcccctagccccccaccccctgacagacccccgtgtgtgatgttcccctccctttgtccatgtgttctcattgttcaactcccacttacaagtgagaacatgcggtgtttggttttctgttcttgtgttagtttgctgagaatgacggtttccagcttcatcaatgtccctgcaaaggacatgaactcatccttttttatggctgcatagtattacatgrtgtatatgtgccacattttctttatccagtctatcattgatgggcatttgggttggttccaagtctttgctattgtgaacagtgccacaataaatatacgtgttcatgtgtctttatagtagaatgatttataatcctttgggtatataaccagtaatgggattgctgggtcaaatggtatttctagttctagatccttgaggaatcgccacgttgtcttccacaatggttgaactaatttacactcccaccaacaatgtaaaagcgttatttccccatgtactgtccagcatctgttgtttcctgactttttaatgattgtcattgtaactggcgtgagatggaatctcattgtggttttgatttgcatttctctaataaccagtgatgatgagctttttttcttatgtttgttggcagcataaatatcttcttttgagaagtatctgttcatatcctccgcccactttttgatggggttgtttttttcttgtaaatttgtttaagttctttgtagattctcgatattagccctttgtcagatggatagattgtagaaattttctcccattctgtaggttgcctgttcagtctgatgatagtttcttttgcttggcagaaactctttagtttaattagatcccatttgtctattttggcttttgttgccattgcttttggtgttttagtcatgaagtctttgcccacgcctatgtcctgaatggtattgcctaggtttttttctaggatttttatggttttaggtcttacctttaagtctttaatccatcttgagttaatttttgtataaggtgtaaggaagggatccaatttcagttttctgcatatggctagccagttttcctaaygccatttattaaatagagaatcctttctccattgcttgtttttgtcaggtttgtcaaaggtcagatggttgtagatgtgtggtgttatttctgaagcctctgttctgttccattggtctatatatctgttttggtaccagtaccatgctgttttggtgactgtagccttgtagtatagtttgaagtcaggtagcatgatgcctccagctttrttctttttgcttaggattgtcttggctattcaggctcttttttggttccatataaaatttaaagtagtttatccaattctgtgaagaaagtcawtggtagcttcatggggatagcattgaatctataaattactttgggcagtatggccattttcatgatactgattcttcctatccatgagcagggaatattttcccatttgtttgtgtcctrtcttatttccttgagcagtggtttgttgttctccttgaagaggtccttcacatcccttgtaagttggattcctaggtattttattctctttgaagcaatggtgaatgggagttcactcatgatttggctgtttgtctgttattggtgtataagaatgcttgtgatttttgcacattgattttgtatcttgagactttgctgaagttgcttatcagcttaaggagattttgagctgagaagatggggttttctaaatatacaatcatgtaatttgcaaacagagacaatttgacttcctcttttcctatttgaataccctttctttctttctcttgccggattgtcctggccagaacttccaacactatgttgaataggagtggtgagagagcgcatccttgtcttatgccagttttcaaagggaatgcttccagcttttccccattcagtattatattggctgtgggtttctcataaatagctcttattattttgagatacgttccatcaatatcagtttattgagaatttttagcatgaatggaytgttgaattttgttgaaggccttttctgcatgtattgagacaattatgtggtttttgtcatcggttctgtttatgtgatgaattatgtttattgatttgtgtatgttgaaccagccttgcatcccagggatgaagctgacttgattgtggtggataagctttttgatgtgctgctggattcggtttgccagtattttattgaggattttcgcatcgatgttcatcagggatattgccctgaaattttctttttttattgtgtctctgccaggtcttggtatcaggatgatgctggcctcacagaatgagttagagaggagtccctctttttctgttgtttgaaattgtttcagaaggaatggtaccagctcctctttgtacctctggtataattcggctgtgaatccatctgggcctggactttttttggttggtaggctattaattactgcctcaatttcagaacttgtcattggtctattcagagattcgacttcttcctagtttagtcttgggagggtttatgtgtccaggaatttatccatttcttctagattttctagtttatttgcgtagaggtgtttgtagtattctctgatattagtttgtatttctgtgagatcagtgatgatatcctctttatcattttttattgtgtctatttggttcttctctcttttcttctttattagtccggataggggtctatctatttgctgacgttttcagaaaaacagcttctggattcattgacttttttgaagggttttcatgtctctatctccttcagttctgctctgatcttagttatttattgtcttctgcttgcttttgaatttttttgctcttgcttctcttgttcttttaattgtgatgttagggtgttgattttggatctttcctgctttctcttctgggcattcagtgctataaatttctctctacacactgctttaaatatgtcccagatattctggtacattgtgtctttgttctcattggtttcaaataacttatttatttctgccttcatttcattatttacccagtagtcattcaggagcaggttgttcagtttccatgtagttgtgtggttttgagtgagtttcttaatcctgagttctaatttgattgcactgtggtctgagagactgtttgttatgatttccgttcttttgcatttgctgaggagtgttttacctccaattatgtggtcgattttagaataagcactttgtggtgctgagaagaatgtatattctgttcatttggggtggagagttttgtaggtgtctattaagtctgtttggtccagagctgagttcaagttctgaatatccttgttaattttctgtctcattgatctgtctaatattgacagtggagtgttaaagtctcccactattattgtgtgggagtctaagtctctttgtaggtctctaagaactttctctatgaatctgggtgctcctgtattgggtgcatatatatttaggatagttactcttcttgttgaattgatccctttaccagtatgtaatgtccttctttgtctcttttgatctttgttggtttaaagtctgttttatcagaaactaggatgcaacccctgcttttttttttttctttccatttgcttggtaaatattcctccatccctttattttgagcctatgtatgtctttgcacgggagatgggtctcctgaatacagcacactgataagtcttgactctatccaatttgccagtctgtcttttaattggggcatttagcctgtttacatttaaggttaatattgttatgtgtgaatttgatcctgtcattatgatactagctgattcttttgcctgttagttgatgcagtttcctcatagtgtcaatggtctttacaatttgatatgtttttggagtggctggtaccggttgttcctttccatgtttggtgcttccttcaggagctctcgtaaggcagccctgggggtgacagtgtctctcagcatttgcctgcctgtaaaggattttatttctgcttcgcttatgaagcttagtttgcctggatatgaaattccgggttgaaaattcttttctttaagaatgttgaatattggccsccactctcttctggcttgcagggtttctgcagagagatccgctgttagtctgatgggcttccctttgtgggtaacctgacctttctctctggctgyccttaacattttttccttcatttcaaccttggtgaatctgacaattatgtgtcttagggttgctcttctcaagaagtacctttgtggtattctctgtgtttcctgaatttgagtgttggcctgtcttgctaggttggggaagttctcctggataatatcctgaagagtgttttccgacttggttccattctccccatcactttcaagtataccaaaccaacgtagatttagtcttttcacawagtactatatttcttggaggctttgtttgtttattttcattcttttctctcttatcttgtttctcactttatttcattaagttgatcttcaatctctgatatcctttcttctgcctgattgattcagctattgatacttgtttatgcttcatgaagttctcgtgctgtgtttttcagctccatcaggtcatttatgttcctctctaaactggttattctagttagcaattcctctaaccttttttcaaggttcttagcttcctttcattgggttagaacatgctcctttagcttggaggagtttgttattacctaccttctgaagccttcttctgtcaattcatcaaactcattctccatccagtttttttcccttcctggcacggagttgtgatcctttgaaggagaagaggcattctggtttttggaattttcagcctttttgygctgttttctccccatcttcatgggtttatctacctttggtctttgatgctggtgaccttcagatgaggtctctgagtggatgtcctttttgttgatgttgatgctattcctttctgtttgttagtcttccttctaacagtcaggcccatctgctgcaggtctgctggagtttgctggaggcccactccagaccctgtttgcctaggtattcccagcagaggctgcagaacagcaaagattccctcctgttccttcctctggaagctttgtcccataggggcacctgccagatgccagccagagctatcctgtatgaggtgtctgtcggcccctactgggaggtgtctcccagtcaggatacacgggggtctgggacccacttcaggaggcagtgtagtcccttatcagagctcggacgctgtgctgggagatctgctgctgtcttcagagccatcaggcagggacatttaagtctgctgaagctgcgcccatagccaccccttcccccatgtgctctgtcccagggagatgctgcctttttttcagagatgccctgcccagagaggaggaatctagagaggcagtctggccagagcagccttgctgagctgtggtgggctttgctcactttgaacttcctggtggctttgtttacactgtaagggtaaaactgcctactcaagcctcagcaatggtggacgcccctcccctcaccaagctcgagcatcctagtttgatctcagactgctgtgctggcagcgagaatttcaagccagtggatcttggcttgctgggctccgtgagcgtgggacccgccaagccagaccactcggctccctggcttcagccccctttccaggggaatgaatggttttgtcttgctggtgttccaggtaccactggggtatgaaaaaaacactcctgcagctagctcggtgtctccccaaatggccgcccagttttgtgcttgaaacccagggtcctgatggcctaggcaccggagggaatctcctggtctgcgggttgcaaagaccatgggaaaagctcagtatctgggccagagtgcaccattcctcacagcacagtccttcatggcttcccttggctaggggagggaaatcccctgaccccttgcacttccctggtagggtgatgacccaccttgcttcggctcaccctccatgggctgcacccactrtccaaccagtctcaatgagatgaactgggtacctcakttggaaatgcagaaaaatcaccccccttctgcatcgatctcgctgatagctgcagactggagctgctcctrttcggccatcttgccagcaaatcccatggtgcctgatttacacacaacattcagtagagagtagtcattgttattagtatggccacactgagaaacattaaatttcatttaattaatgacagggattttttattgttaatgaattatcaataattccttggtaatcttttgggctttatctatttacatcccagcatcccaaggaaagattggtctccttgaagtcagtagttttgtcttattcatcactgtatctttagacctggcttaatgccaggactactcagtaaaatgccaattaactcagtaaacattagtgaaatgtataagtcagaaaaataaacgatgtttttaggaagtttgaattgaagaaaagaaaagcaacttgagatagaataggtttgagagaaaaattttagaaargagaagctttgagcattgtcatagactgatggagattcagggaagaggcagagattgaaggcagaaaagagarcagagctgatgaggcagagccaacaagggaggggacagggccactggaggatgggaccaatggcacaggtaaagaaagagattaggtctcaagagatccctctttccctgaaacagaagagcaaagagaaaggtgcaaatgcagtttaacattgaagttaaggaagaaaaatccagggggcttctattgggttacctcttaccttctgctaaggggaaggaattagagctgactgaagggcctgaatacaaaagttttggaacaacttcaggttacatgatcgaagtttcaataatagtaggaagtgagtagaccacctagcatcattgagggcccatacaaacctactgaagctgatcagtttgcttgcttgcctttttgtatatttgtccatttatgtattaactaacattcaaaaataaataccagctgtatagatttgctggtgtattttccttaacttctcttggggaaacagctgctgtatagtcagtatgtgttgccgatttggagtcatgtcgcacactatctctgcaaagtctcttttctgtttaaatattggtggtccgctaacaccataagtgtggtttacagttatcggcctttgtttttargtgttgtctttttccattatcattaacctgaatttcscatgcatgaaaattatcagcatgataaggtggaactgctttatggcatgcatttaagtaatcttyaagtcttatctgaaatgaartgtgctaaaactactgaggtttttttgtttgtttttccctagagttggacaagttataaccatcaaagcaaaagttactagagcattcagcacaagcatggaggtaagaggcaccttttcaaacatctgcctgttggtgctcacttcttcattgtttacaaagggtagagcaggaggcctagactaatatttggagttagtgagattctctatttcasaaggctctggaatgtgtagtcaggtcacaggtaaataataagcagcagatgtttccactgtttcccagctaaaattcaacatggccaggcatggtagctcacacctataatcccagcactttgagaggctgagacaggaagatcacttgagaccaggagttccacaccagcctgggcaagatagcaagacccaatctttaagaagaaaaaaaaaaattagccagcacagtggtaagtgcctgtagccctgggtactcaggagacggaggtgggcggattgcttgagcccaggagtttgaggctacaatgagctttgattgtaccacaacattccagcctgggtgacatagcaagactttgtctcttaagaaacaacaacaacaaaaaaaaccaacacatttaaacatgatacagtacactatttctacatagaaggatatacagaaagtaaacctgcaagagaaaaggacagtcttaattctttataaagcatggtttttatttcttaattatgctgactctactattattctaattctgtttgttctccatcccctcaacctctgacagaaactagtcccatgattaactagttttttaaaagcaggataactggactttagtaagaaggtaaatttagaagatttttattctgcatccacttgattttattttctctaccattgtgaatactggattctcaggggctcttgagatctcyattcaggttaaattagcaggaaaggagttgctggatctcatattgtacctcccaggttgctcaggatcagtcccttcaatctctgggcatgaagacatggaagagtttgtattcatttgttagggctgccgtaacaaagcaccacagactgggtggcctaaacacagaaaagtagtgtcccacggttctgggagctagaagtcctacatcaaaatatgggcaaggatggtttctctgagggctggagggataatctgttcatgccgctctcctaccctcccatggctctctgtagtctttggtatttcttggcttccactgcatcacccgatctctgccttcatcttcacgtgttctccttgtgtgggtgtctgcttccaaatttcccctttttataaagatatcggtcatattggattaggggcctgccccaccgcagtctggcctcatcttaactaattacatctgcaacagtgctatttccacatttacattctaaggtactgggggttaggacataagaatttggaagggggaacacagttcagttataacaactgttttgacagtaaccatgccattggtggtggctttaccctgatgtggtcactttctttttttttgtttttgcttttgtttttgagacagagcctcactctgttgccaggctggagtgcaatggcaagatctcggctcacggcaacctccgcctcctgggttcaagtgattctcctgcctcagcctcccgagtagctgggattacaggtgcatgccaccactaatttttgtatttttagtagagatggggtttcaccatgttggccaggatgatctcaatcttctgacctcatgatctgcccaccttggcctcccaaagtgctaggatcgatcacaggcrtgagctactgtgcctggctgatgtgttcactttctagcagtatccaaataagcagaatacaaagcacttgaagaaagcagaaaggaaatgtcgtgaagaaaacaagctctgtcagcaaatggtgtttctggagcgtttattcaactgtggggctcttagcctttgcacacaggagcctctgggcttggcctgtctcctgagggccacacattctcctgatagacagtccaaatatagataaawcctcctttacatttctccttttcctcctcttccctaagacaggctagaatttctaaaggaggcttatctaaaagctaagaaaacaaaagtaaaacccagtgagtttgaaaccacagatttctgatgctggggaaagtaaaccctagcctccactgactttccaggcctgatccgccgtgcagaattttgttctctttcatcttctgcaaatcatgaccaggcagcctctaaattttgtcatactttctaccacctggtagaaatttcttggatttttttccttaaatatagatgccaactaaacatttttatttttactttttcaaactggacatgtcctttagcgtcttcctgttcaatttcagtttcctgccacaactgaggccagccctctgctaatttgctgagcagaaataaatgactgacttctccctgaatccaaagcaagcaggaactctgctstgtgccaaacctacttccaggggattctcagactctactgatcagtctcttccctcttcccacctctggaaggtgtgtgatgcattactattaatagatgatattgtctcatttgcactaagagcacattatatgagtgtgagtttttttttttttgtccttagaatatgtctttaagaatcagttttattgagatataatttacaacattaaaattctcccattttaagtatacattttgctgagctttgacaaagttatacagttggatcaccaccactgtaatatacaacgttcccatcactacatgaagcccctttatgcccctttgcaatcagctctctcagaccccagcttgtgacaaccactcatttacttcaggtcagtacccttttttttttcttttttgccctttactgtattttgtataaatggaatgatatagtatatataatttttgtgtctaatttattttacttagcataatatatttgatttctgctgttggttattatattattctcattctatttattttgggtttaatttgcctttctttttctagtgtcttaaggtagaatcttgggaaattgattaaacttttctttttttcaaatataagcatttaagatcgtaaaattttcttcaatatattgctttacctgcatcaaaatatgtcctttttttcttgtaaattcttccctgacctctagtctgtctagatgtgtgttgtttaatttccaaatctctgatgatttttccagatacatctttatgtttttgatttataatttaattcctttgcagagagagaacataatttgtataatttcaattattttaaatttatttagacttttttaatgacccaaaatatggactattttggtgaatgttctatatgtgcttgaaaagaatgtgttgcttatagtcaatgaagtattctgcagatgtcagttagcctaacttggttcacagtgttgttcaagtcttctgtattattattattattattttttgagatggagtcttgaactgtctcccaggctgtagtgcggtggtgcgatcttggctccctgcaagctccgcctcccgggttcaagtgattctcttgcctcagcctctcaaatagctgggattacacatgtgcaccaccacgcccagctaatttttgtatttttagtagagaaaggatttcaccatgttggccaggctggtcttgaactcctgacctcaggtgatctgttcaccttggcctcccaaagtgctgggattacaggcatgagccaccgtgccctgccaggattcttaactcttcctgatgttgtgacccttttatcattatgaagtttgcctttttatctctggtttttgttttaaaatctactttgtctgacattaatttagccagacaagctttctttggtttagtgtttttttccccatcatttttctcttaacctgtctttttgtacatgtaagtgggtttcttataaacagaatatatttggatgctatttttttatttattctaacaatctctgccttctacctggagtatttaaactatttacatttgattatctatatggtagagttgaaatctatcatctggctgtytgtcttctatttcttccatctgttctttgtttcttcctgtccccatcttttcctgcattttttagagcagagtaatttttagtaatccattttatctccactgttggtgttttaactatacatatttgttttggttttaatgtttttctcgggtttgcaatatgactacttaacttatctgagactaccttcgaataatataatatccctttgagtatagtgtaataaccttataacagtacacacacttcccttcccatgtcccagcctttgtgccgttattgtcatgccttttacatgcacatatgtaggaggtaaaccctacaatacatagttattatttatgttttaaacagtcaatcatcttttaaaaagaatagaaatgaaaagaagtattttatatatatacccacatatttgccatttctggtgttctttattcttttgcgtattgtgtatctccagatgtctccctagtgtcattttccttctgtctgaagatattcctttagcatttctttttcagcttttgttcgtgtaaaaatgtgtttgtttcatcttcatatttaaaagatgctcatattcagtaggtatagaattctagcctggcagcagacttatgtaaattatgatatggcttgggtttctagagctactggatctatggatttatagtttctaagaaatgtggattttttcagctattatatcttcaaacttttttcctgtcttttgtgctctctctccttttggactttatagagttttagacttcttgttagtgttccacgggtcactgatactgttcgtttttcttctttyagtcttcctttctcttcatgctacattctgtgtagcttcttttgtcatcttcagcttcactgactttttcccctgcattaactaaactgctgttaatcttatctggtttgttttttatttcagatgttgtatttttttaccttagaaagtccactttgatttttttatattttccgttctttcctcattattttcatctttttctctatattaggagtcagcaaactatggcctatagacctgtttttatgaataaaaattttttgtagtacacccattaatttatgttttgtctgtgtttgctatcacagtacattgacagagttgagtagtggcaatagagtccatgtgaccacaaaacttaaaatatttactatctggccttatcctttaagaagatattgctgactccttttccaaatctctgagttcatggtgcttatatttaattgttgttttagtatcctttgttgttattccatcatttctgttatctgttgttttatttatattacctttcacctaataattttcttgcatctaatattttttactcgatgctgaacattgtgaattttatattgtttagtgctggcttttgttatatttctttaaaaagagtgtcagacttttcctggcaggaagatgttgttacttgcagattggtttgagcctttaaagatacgttttaaactcttctatggaagatttagaatactctactttagggctactttagcccctcttctaagttgggatcttctgttatgtctatgaaggtgttatatattcagtgaaatctggctggagagaactcaaaagatccccagctgtgtgtgagttcttggaattgtccatgttacagtttcccaggaattgcttgttcctcagaagctgttcttgtctggggtttcaccctgtatatggtccagttagtatcaacccaaagactcacaggcatatttctggaattctttctctttttttttagyttccttctctggtactctaacccacaaattttagctccattcaattcagcagagttaggtttttcttctctaacctaaccgtaaattaccttcagcctgagaacctgggaacgcagtgctctcgttgtttttcccgccttggggatcacagtcctgtgttgcctattttcgtaggtgtgaaagtagatgcttcctatattttgtccagttttctagttgttttcacaggatgtaattccaatcttacctaatctcttataacacaatgaaattctccctggcatatgtttttgaaacatttggtaatcacatataactaagttaactcttctagtagaagacagtgtttagaacttattttaacactccagaattgttgctttgtttttactgttaggtattttattttatttttcatttgtccatttctctaaaagcagaaagctgtgtgggattgagggttgagagttgggaatagatagtttaattttggctaatcatcatctagttaatttaggatttaccatgtaaatactaatttgcatttatgaattgagtgacttaaaatgagtcatagattattgattattctttttacatggtgtacacagtaaagatacagatacggatattctttatcgttgataacatagtgctgagctgtgcctgagatagctcattattttcagaagatagtattactcatctgaaatatgtagggaaaaggtttattagccagaatctaaagacragtacctgagtttaccaacacttctgcgaagtgcaatcctgaggaccaagcttcagcgctcttcacacagggggaaatctagcccattttagtatcaacataaagtgtctcagctaccttcttattactcctgaaaaattaatcacagaaacaaagctgtaaatacatgatgcaattctgtccgtgttagcttggttatgaaactctgagactatgctgcctagagacatttaaaaaaaggaaaaaaaactctsakagtaaaggctaaaaaagttatggtacatctctctggtggttttataaggcagacaccaatatcttgttttcaaaagcatatttagtaatcatgaaatttaaaagagctttcatataatgccaaatttttaaaaattggaacaggccaggtgcagtggctcacccctgtaatcccagcactttgggaggccgaagtgggtggatcatgaggtcatgagatcgagaccatcctggccaacatggtgaaatcttgtctgtactaaaaatacaaaaaattagctgggtgtagtgctgcgtgcctgtagtcccagctactccggaggctgaggcaagagaatggcttgaacccgggaggtggaggttgcagtgagccaagatcgtgccactgcactccagcctggcaacagagcaagactccgtctcaaaacaaaaaaaaaaaattagaacataaaactgtaaatacattacaataattttatatacacatgcatatatacacacacgtatttcatgtcatatgtatgtaatataaaatgtgtgtatatattatgtaatatgatattatatatgtgtatgtattatrtgatatgtatgtgtatatattatatatcatatatgacatcatatatatcatatacacttatatatcatatatgatatatagaaaaagctagaagaaaattcacctaaaatttaataattattatctctgggtgatgggattactgataatatatactctggatagtcagattccataaatttgacatggtaaataaataatttttataatcagaaaaaagctaattgtccagtgttatagaacatcattgaaataattctattgcttaaaaataaattaaaattctggtttcatttttaaaatgaaagaaggtaatggtgcatacatatgactaaattttgaatgctgaaatctgaactggccaagagtgtatttatttatctttttttcattttagatcagtatcaaggtcatggtacaggatatgctcactggcattgagaagcttgttagtgtggctttctccacatttgtagccaaaccagttggaaaagaaaaggtaaattttgtatgtgaagatgtatctagcrtgtaattcagggacatagtaacaattgcatcagaatgttatagaaaaaaatgacacttcttctttccatgagatatacttccccaagatttgttattcaccaatatttattgcaaaagttatcactctgtggtaacatcagaggaataggaactttacagaaaagtaccttagagaaaagacgatatagaaagtttgtaaaatacaaaaaaaaatccacattgttttaaatgatctgaaggtcatattggtttctttaaaatactgcctactggtttagtgcttttcatttgtggtcatataactcaaaattgacttaaaataaaatctttttttaaaaaagcaagagcaatttagcaagcagttgcatgttatagattaaccactgttaatacctgaaggaaaactgtcaacattgctgagttattgaagtttaaaaataagcttctgggcatgtggggtgaaaacaccctccgaagtgatactttggcctgatgagcttgcctagccggctgcctggacacgatccagatccactcatctggaggctgctggagatttgctccttacaatttcttggcttttttttttcagtgtcagggtgcctggaggagggtcccatttagtctaaacactgtgataattcaatctggaatatgagtctttcactccaaggatcatcccagagctagacacagtggcttctcctagctctactctgaagcaaggaggagtcatgttggtcaggttggtctcaagctcctgaccacaggtgatctgcctgccttgatctcccaaagttctgaggtgtgagctatggagcctggcctgcactctcagtctaacattaaacatgttgcaaggcaaattcatattgcccaagggtgttatttttcaaatggaagttcatatcagctaattctattttttaaaatgcagttttctgggccatatcatggacctactaaattagaatcactagtgtggaatcttggaatctgtactttgccaaagcatcccacggagcctgtgttcactaaaatctgagacactgagatagtcttcccaaccattctgtttttcctggcatccccacaaatctccagactcttggaagtgagagaataggggatgggtgcaggtgcccgtatctgagcgcaagtgacaaaggaatacaccttgcaatcccattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataatagtcacacttcagtccaatctctcttgagactggagaactgggttctgaaagtggaaaatcagatccattatggtgctaacataattggttggttcagataaccttaattgtaaagcacctttccagactaacttatttcctagttgctaatatgctggttcagcagctcatcacaaagagacccatgaaaaatcagtggtttggtttgaacccataggactacttgaatttctgttcacagtgggtttattttaggatgaagttggttcaaagcataatgtacgctgattaaaaaacaaaaaagaaattggcaatgattaaccagacttagttcaacaattgcacaggccagatcattgaagggacttgcaagactccacagggtacactcatgcaaagccttactaagctaaagcagatggtgcggagggagaaagcaagcacaggccagcctcagagagggtggaggtctccaggcacagccatgctgctggggccttagtaacacaagatgtacttctgcagaacagaaatcaccaaaacatatgcgaggtatcttggtttcaggagaaccaacacacaagtttaccaagcagtcttgtataccctgctagtcacacaactaaaacaacactacaaaaattgttaaatcaggctgggtgcagtggctcacacttataatctgagtgctttgggaggctgagaaggaaggattgcttgaggccagaagtttgagaccagcctgggcaacatagtgagccctcatctctacaaaaaataaatataaaaaaattagccaggcatagtgacgtttgcctgcaatcctactgagaggatcccttgagcccaagagtttgaggttacaggaagctatgattacaccactgtgctccagcctgggcaacagagtgagaccctgtttcaaaaaaaaaaaaggagttaaaccagtgcatgccatcaatctacacattcctaaccaaattccacaaggtagtccagggcagttttggactttaagcagcatattataaatcaccagcttatttcttatttctttttttttttttttttttttttgagatggagtctcactctgtctcccaggctggagtgcagtggcatgatcttggctcactgcaacctccttctcctgggttcaagcgattcttgtgcctcagcctcctaagtagctgggattacaggtgtgctccaccatacccggttactttttgtatttttagtacagacagtgtttcaacgtgttggccaggtgcagtggctcacacctataatcttgaacacctgacctcaagtgattcacccacctcagccccacaaagtgctgggattataggtgtgagccaccacacccagggatcactagcttatttcatccttatcttggccaagggtccgtaccagactttgagtatcttggaaacaagcatggagctaccccagtccagcttcaaggtgacccttccttctacacacagggtcagcaaagggcatttatgtaagaatttgagctcttggttctgtnnnnnnnnnnnnnnnnnnnnnnnnnnnnnnnnnnnnnnnnnnnnnnnnnnnnnnnnnnnnnnnnnnnnnnnnnnnaagttggtgaaagctttattcctacatattgattcttttgttttgcttattagataatgttttcaccatgtaatgaaatttccaaattggtatcatggtataagataactttctctagaacatctttattccctctctttgctttcttaattttgcaaaatttattccctctctttgctttcttaattttgcaaagataggaaatgtttagatttcagtggagtcaaagtccatctcctcattcatcaatatgaataatttcttattttgtagttctgttgaaaaattttaaaatcagggaaaataatagagagaatttttaaagcacatatcttattgcatgaagaaataattacgcctatgttgatttttttagtttaaaaataatttaagaaaaaatttagtcataacatgtttagtgaaaacactcataaaagctctatttacttgagttagaaaaccatgtagcatatcatttgttttgcaaaattcatgctgtgcttttataatttaacaaggcaataaaagataaatgcttttctttctctagattcatttaaaaccagtcacacttctaactgaacaagatcatgtggaacataatctggctgctgagagaaggaaagttcgattacaacatgaagatacctttaacaatttaatgaaggaaagtagcaaatttgatggtcagtaaatccrcttataagaattttaattctataactgtgacaggcaaaggagtcttttcttagagcacacttattttcaccttattattaccattcagtcctggtgacactaggtatcctttccaacaaacccggtggctggagaagaaacctggccattgagaatgtaactgctgacacctaaggcctctttaaattggaagatctccaggaaaggagatggggaaaaagggtgacagggaccaggcagtcattagtaagcatgtattcactaatgatggctgaatgaagggttgatgacaatgccatacattgacacggtgcttcgtggcttactaagcagtttctcgtccacggtttcataggagctgcatgtaatctcaacagagcagaaagctgcaactctgagtaggaaagaaatttgctaaagatcatatggggtatgagcagagrcttaagatcctgctcctgttgcctggtgctttccacaatcaccctgcgttttatgagccacacttccttagttctctggcagtgatttcctgggctctttgatgcctcctggagccagactggtagggaaaggcagagccccgcccttgcccctcctctgccctttctttttgtctgaccctatcttctgaagccccaaggggtgccggtggagagcacaatgagggaggggaggaagtgaagtgagcccgcccaggccccacaagctcaccactgccaagagggcagaaggttcagcamcccttggctccaaaggaaggcaccggaagaagaggaaggaaaggagaggacaagaacatgtcagaacaaggatgtcaaaagagaaggagaaagagtgcatggaaaggccagaggaaagggagaggtagcagccagtatggcagaagtgcaaagcctttattctgccccaggggatatcctgggaccaccccacagaagacttacgggttgaaaaagagatttttcaaaggtttctactcattgctgacctttcaaagggcaatacccattaccaacttgatttttttttttttctttgagacagagtttcgctcttgttgcccaggctggagtgcaatggtgcaaactcggctcactgcaacctatgcctcccaggttcaagcaattctcctgcctcagcctccgaagtagctgggattataggcgcgtgccaccacgcccagctaattttgtatttttagtagagatggggtttcaccatgttggccaggctggtctcgaactcccaacctcaggtgatccgcctgcctcggcctcccaaagtgctgggattacaggcatgagccactgtgcccagcccagaccaagttatttttaaggaaatgaagacttcatcattaaatgacggtgttaagaagagcaagtctccgtttataaagctggtctcagcaccaaaatacatttcaaatgcatgttgctcaagtaatgaaatagctgaaccaagagaaccaagagaagctgctgaggcaccctgaggcaggtgagacaaccattaataaaaaacaaaaccctgctgtctcctcatcccttaaatcccaaggaagaaatgaaatgacagataaaatacttactaatgagcaaacccgttctatgcatgacaagtaaatctcttaggacatcttaggaaactcaagcatttaacacagtttttaataggcatatgcatttcccctagtttcattggtcttcctttctgcagttatgtcttttaaaaaagctttctgtcctcaatgaaattacactacctgagttcataaggagaaagtagaaataagccactaaacaaccagaattctgattgacaatgtcaaaatacagttgtttttcttcttcttctttttttttttttttttttttttgggagatggggtctcactctgtcacccaggctggagtgcagtggcgcaatctcagctcactgcaacctctgcctcccaggttcaagcaattctcctgcctcagcctccagagtagctgggactacaggcatgcgccaccacgcccagctaatttttgtgtttttaggggagacgaggtttcaccacattggccaggctggtcttgaactcctgacctcaggtgatccgcccaccttggcctcccaaagtgctggggttacaggtgtgagtcaccgcgcccagcaaggaacagttcttttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctttcatcctctccaagtcatcccctcgtctgaatcacatctcaaggtcattctccacccttttgcccggaactctctagatcaagctgctgcccaccaggaagagggtgaccctgtgatgcgtgaggtgctggccagtttgccccggtgcatgctagatggagtgtgtgtgtgtgattgtggataaaatcattgatagtcatataggtggaaggactccttccctctcagcagcaaggaaagacttccacactgactggtagttccttccaacagttctgtatgaaacgcctgtcatgtgccaggaacctgcttgccactagaggtataaagatgaataatgcagggtctttgctcttaagaaacttgtagtttaktgctggagacagacatattaatagtttctaaataatatagtaagtgaatagagagctgtagactctaagtaatgtgggagcccagaggaagggcccttcagggttcacgagagactcgctgcaggaggggctatgagaagaaagttgggaaggcgaggaattgcgtagcagtgagggtgaaggcacggaggcatgaaccagcacactgtgtgctgggaagccaccaacacaagagtattgctagagagaaaatgcaaggtagagggaggcgggagaggaagaaggtaggattgtgtcatggaggctccctgggccatgycgagaggcttggcctttcttctgttcttgatgggagccattgaaggattttgagcagggttggggcatgactgggtttgcacttaatatggtcactctggctagagggagagagaccaggcgaaaggcgaggggtgcctaaaccaggcagtgatagtggggagagacaggagggaaagagtttaaaaatacacacgagatcacaccaacaaaatagggtcaccgattggctgtggggagaagggcgaggaagaaggagcataggctgactcctgggtgtctgcttggagcagctggttagcagttgtgccatgaactgagatcatggatctgaggggcagggaacggcaatttttgggaggtagatgatgagttcasttttaggcatatggagtctgaagtgcctgtggacatccaaaaggaagagaccacagctggggagatttcatctgagagacaacyrcttagagaagtagttcaaatgaagacaacctgcagcccacagggtgctgggccaagaacagaacctgcaaagcacaggcatctaagagaggatccagaaagacaaacctactaaggagacctggagggactaatcagaggggtgcagggagagctggagagagcagtgtcacacrccaaggcagcagagttacaagaagaaatagtaagtggtcaactgcgtcccaggaagtgaggaataaaacctgtctactggactgggaatcaggaaggcattggtgacatcggcaagtgtggggttagaagaagtgtgggagacacttggatgaccttaattacttagaggaataatgggatgagggacagtttaccataacctttatgtcatatacacaggccaaagtaaacactcctatcaccaggcttgtttgaagcacatgtacaaggatgcggggggtggggagggaagtagagctgcgagcctcatggccccaacagcccaagtgtcatctgttgcaggacatgtggacggtgagggacacagtggccattgcagctcttagagcagcttggctagttcagagcctttgcttttgtggaaaactaaggcattgtttcccacagcagcactagcatttagcaggaactcacttctctcaaggtattttccttcactccagccatccaaggtggaacttgctcctctctggcctctggacccagccccacaggaagcaggaggcatccatcggcccactcaacccaaaccatccaccctggagagagctacctcctcccaccggacttactcctaaaggcgaattgctaggagctggccctatgcattggctcatctttttctcatagtcagtggttgccccagcacaaagctgctctttttattttcttatccaacgctttttttatccaggtctgtaaccaagtcctctgacttggcagaaccatccttctgctctctatctttgtgagttcaattgttttgatttttagattccacaaacaggtgagaacatgtgatatttgtctttctgtgccctacttcttttgcttgacataatgacctcagttccatccatgttgttgcaaatgacaggatgtccttctgtgttatgctgaatagtactgtaacaggtctataaccaaaacctctgactttgcttttctcagcttgccgaagcaaggtaaataataaacaaaacgagaactgtaaaatgggaataataaaggtacttacataatgggtttatgggagcattaaatgagttaatatagaaagtgtcaggcatgcagaaagtgctgtcatttctattattgtttgagaggtcccctccacaggaggaattagagccaagagttaaagacagatgcttctcaggaactatgctgtaaaggatgaaagaaatagcctggagctacaggagaccctcaaagtcaaggggcattgtttttcaggctaggagaaatttggtcatggttccaggctgatcaagatgattgatgaggcctggcggtggcttatgcctataatctcagcactttgggaggctgaggcaggcggatcacttgagatcaggagttcgagaccatggtgaaaccctgtctctactaaaaatacaaaaattagccaggcgtggtggtgcactactgtaatcccagctactcaggaggctgaggcaagagaattgcttgaacccaagaggcggagtttacagtgaaccaagattgcaccactgcagtccagcctaggccacagagccagattctgactcaaaaataaaaaaaaaaaagacataattgataaaaataattattgaggaagaagttaattataaaagaaagagataattcatgtcaaatctgtactttagacactgggaaattgttgtcatgtttttatcttggaggaatggggatctctgctaccctgagctcccttgcgagggttcgtctattgggaagggttgctaggatggtgactgaagctgtcttcacacccccctcaaggtaacaagagccaggtaaacatgggtggctgcaccggcttcttctggtgttgtgcaagttgcactaataagtgaaatcagcagcagacaatttgtctgcacaacactaayagtactttgartactggagatagtctaaattagtgacaggcacacatgacagtcattcaaatatagagataaaacgattgcaattgacttgagtttcagtgtgttacaaagttggccagattagatctacatctacatgtctagttcawagttcaatttcaaattatagatttttctcaaagtcttcttttatcatctgctttgtttaatctgccctaacttattctacatcctttcacataaaacaacttttaacctaattccactgatctgattttgtttttggaaattttactaacttccatgccagcaaaggtgccagagaacttawaagcaattcatcttaaagaatgcaagagccagactctgacatttaaagccgctgtgtagtatgtgatttctccacctgctgctccttagatcagatggagttggtttttgataggacattgtgtgttctaaaagaagagaaccaacccatctctgttcttgtaccatgtttttagaaaaccaggggtttgtgttggttataaatatcaaacataaaagattggaatatttttcaagatgttgtatgatggaaatgcatattattagaacagtgagaacattgaatccagatcatatcctttcggaagaaaagaaaagagatgagattagttttgtaaaagcaggatatttctggaatgtgtataagcacgcacatctcagaaatactactggatcattatttgcaagcttgacatataggggaaaaacttaaaatttgaaagcattttaatttaatttttgagtaagaaaatcagatcttaagagcattatcatggttaattttctggatatgcagaaagaaaactagggctagcatgacctcaattcaggtcaaagttcctgatctacaaatgtagagtgaatgtaaagttgtcaaagcaggttgatgacacagtactttaagaacatccaaagtacacgtattgaacttgatcactcaaagccagcagaaagggtgagttctgtttacttaacccaaaccagaactgcgagcctgaattgctctctgaacctgggaaaaccctatttttttcgttggttgtaaattaactccaaataagcaaacttctgyaccaaagtcatctaactcaatatatttctgcatacgtatcatagctgatgctggtgcacgtataatctcacctagcacctccctctacaggttccagtatatactgtatatgtcttcataggaagtatgtggtttctctttaaagttatccctcagaaaagaargagctgctttatatttgagtctttacaatgtctctcrtaaggccttctcttaattttttatttataattatctaaaaactatttttaaagagatagtacatgcacagggtaaaaaatgcaaaacgcataaaaaggcatatagttaaaaagtaagtctgcctaccgtctcacttcccaccttcagagaccgtcactatcacacacacttcaatttytgtgggtacacagtaggtgtatatatttatgagatacatgaaatactgtgatacaagcatacaaatgtgcaataatcacatcatgtaaaatggggtatccactccttcaagtgtgacaaacaatccaatgatactcgttatttttaaatatataattaaattattattgactgtagtcaccctgttgtgctgtcaaacactaggtcttattcattctttctaactatatttttgtacccattaaccatccccaccctcccactacccttcccagcctctcataagcatgcttctgctatctccatgagttcaattgttttgatttttagctcccacaaataagtgaaaacatgcaatgtttgtcgtttgtctttctgtgccttatttcacttataatgatctccagttccatccatgttgttgcggatgacaggatctcattcttttttatggctgaatagtattctgttgtgtatatgtatcatattttctttattcattcatctgttgatagacacttaggttgcttccaaattttagctattgtgaacagggctgcaacaaacatgggaatgcatatatctcttcagtatcctgatttcctttcttttgggtgtatacccagcaatgggattgctggatctgatgatagttctgtttttagtcttttgaggaacctccaaactgttcttcataggggttgtactaatttacattcccaccaacagtgtatgaaggttcccttttctccacatccttaccagcactggttattgcctgtctttgggataaaaggcattttaactgaggtgagatgatacctcattgtagttttgatttgcatttctctgatgatcagtgatgtcgatacctttttatatgcctgtttgccatttgcatgtcttcttttgagaaatgtctattcaaatctttggcccattttttaatcagattattagatttttttcctatagtgctgtttaagctccttatatattctggttattaatcgcttatcagatggatagctttcaaatattttctcccattctgtgggttgtctcttcactttgttgattgttttctttgctgtgcagatgctttttaacttgatgtgattccgtttgttgatttttgctttggttacctgtgcttgtggggtactgctcaataaatttttgtccagaccaatgtcctrgagagtttccctgatgttttcctataatggttttatagtttgaggtcttagatttaagcctttcatccattttgatttgatttttgtgtatggtaagagatagtggtctagtttcattcttctgcatatgagtatccagttttcccagcaccatttattgaagagattgtcctttccccaatgtatgttcttggcacctttgtcaaatatgagttcactgtgggtgtgtgaatctgtttctgggttcccagttctgttccattggtctatgtgtctgtttttatgccagtgcctggctgttttgcttactacractctgtagcataatttgaagtcagataattgtattaatttattttaaacaaaaaatgtgccatttgagtaagtaacattagcctgaaaacaacctcaataaatactagtttgggatatgtataaaacatcttcaaataaaatcaattttagaaagagagagaaattgaaagggattaagattgtgtatttctttcaaagatcactttagaaagtgattccattttgattctagcaatatagtggattcattgttgggtaaaaccaaaaatttctggaaaaatatttacaaacatctttgcaaacacatctcagcaggcagaaaaataagagaaaactttgaagtccagaaatggtgagaaaacacaaatgccgcagtgcaaggaagcatgggggctggcatttgtcctggaggacccagcaggtgggcctgcttgggctcaggagacaaaaccaggcgtccatgtgagggagaaggttggatcagggaaccttccttggtgctggaacctccaaaaggtgattccctcagtgagtcaaccagaaaaattccaccctccagagagccttagccttaggtggaatgggaaaaaaaattctctccctttcagaattcaatcacaagtgcatcctcatgaagatttggatcctcagaagtcacatgacctgtctgggctaaaacagaacaagtaaactttagtgtaaagtggtgctgtgttgtaggaccccaggggatctgcagctgcaaatgcagctcctttgtgaagaaatgactttaaagccagctcccaagaatttycacagaaaaagatccaagcaatatgagatcctagtgaaaaatcataaaagatagaaataaagcaaggcttcaagatctggaagtgacaccaggccccacaaagtctgaacgaggcccacaaagacagcagataatgaatttatcaagtaagatgaagaggcttaatatgttttaagaaataaaagagtatcaagagtataatgcaagaacaacaacaacaaaaaagataacctagaaggtttaacaaagaaacaaagacgatttctataaaaaagaatatataataattaaaatttgaaactcagtgaatgaatgaaacagcagataagacaaggaactggaagatagatctgaaagagttaactagaatgcagccagatagacaaagagatggggaacatgtaagggaggttaggaaacatgaagaatggagagaaatgtctaacatgcaaaaaaattctccggaaatgagacaagcaatatttgaagcaaatgatataaagagacatttcatgaagaggtgacaagaatacttaatatacatgtaaaaagatgttggaactcattagtaatcaggaaaatgcaaattataaccaacgtgagatactcttccacacccaccaaactggaaatagttgagtgtctgatacttctaagcaaaaatggggaccagtggggactctcatcaacagcagacagaagtgtcagtacaactattttattacctaaaaatattctgttgagagtaaggactatgaatgttaaggaaatcagctaagttaagtttattcattcatttcatttaataaatatttattgagcacctatgttcaggaattatatgagaattttaaaaatccatagtccctgcaccaaaaagcttaggatctagtgggtcacataataaaagggcacacaaataacataaaactatagccatgaaaggaaagatccttcaagagaccctggaaggtgggggctggagctgtgggaggtcagagaaggctccactggagggaagtaatgaccaagggggggccacagagtatgagtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattaattataaatctaaaaattacattaggaagtggaattaagggtttctgtgactacccttctggatcaccagatgtgactatgccgagagcagcaacagttgctgggcatatcttccctctcacactgcaagctcagctctgcctctgacagtacagccacgatggtgtcccagtttgtaaatcctttccccctccttcccaacaatagcatgtgagatggaaacctagccggtggttcacttcgtgatgcaaaaagcataattgaatacattttactgctttgcagccagagtaaatgatttttccattgttaagagtaaaaaccaatttgttagtaaacggagcagatatgattcaaaagaagcagaaagctaggcgcggtggctcacgcctgtattcccagcactttgggagsccgaggcgggcagatcacctgaggtcaggagttcaagaccagcctggccaacatggtgaaaaccatctctactgaaaatacaaaaattagccaggcgtggtggcacgcacctgtaagcccagctactcrggaggccgaggcaggagaattgcttgaacctgggaggctgaggttgcagtgagctgagatcgcaccactgcactccagcctggatgacagagtgagactgtctaaaaaaaaagagagagcagaaggacatgaagaagtataacagattgtgtctttcctgcttgtgactgcaatcattacaaacagtttccgcaggaggccacatttccattctgaaggtagtgtttcaagcttcctggtgtctctggtcctttgtagctcagattcctttatctttaacaacttyattgtggtgtaattgacaaacaatgaatggcccatatttaaagcatayaatttgataagttttgaagtaagtttacacctgtgaaaacatcaccacaatcaagataatgacatatccatcacccccaacatttctgccccttcctgtcctgatctgtccctaccccaccacaaacaactcaagtttcagtgtaaccattcttttagtcaaaattccaatagacttattttataggctagaatacaatctctaaaaggccctttctgattatcttaacccaattcattgcaaatattcaccattaagataagagtcactctgtagaacctgtcaattttctcagtcttaaggctttgagaacactttaatttttctataaatccgagttgaatgtactgccgggaaggaaaagctggagccccagggcctatggttcactccaccatcattaatgtttacatccacctttcagatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctgcaaggttcttggttttgaccttcggcctatgattttgggaccagtgaggagaaagtagaaagggactgagatccagttcttgggatagtcaagaagtcaaggaaaggactgaggaaaatgttgccttttataatgatttctaaatcatttactttcttactttaggattaatctgtccttttgtttgaaggtgaatgtttaaatattttggttcaaaaataaaaatgagatgacagttttaatactttattctgaattatgaatattsatcttatgaaactgcaactcattgtcttgatagcttatgacaaagtaaatgcagaacagaaatagaagacaggcttcacacttaaaaataatcagtctaggttgggcakggtggctcacacctataatcccagcactctgggaggccgagacaggaagattgcttgatgccaggagttcaagaccagcttgggaaacatagcaagaccctgactctacaaaaaaaatttgctggtgtagtggtgtgcacctatagtcctggctagttgggaggcggaggtgggacgatcacttgagcccagggattcaaagctacagtgagctatgatcacaccactgcactccagcctctctataaataagtaagtaaataaataaagtcagttagttacaaacctttttaaagacaatttacagttaggtctgacctttaaaggtgctggttaaaaataattatggccaaagaaataattgaaaaataggaaaagaaagaagagaatatttagaatacttttaaagactcctcaatttcaaaaaggttattttattcttaatggaaagatgtaggtaattgagcagttttagggaacactctgtaccctgtaaatgcatttgaataggatctgcccttctgacaattttcataaccattgaaaatttttaaggttgtatttccctcaaattaaaataattttattattaatatgtctatagttatgactatagttacaaaccagtagttatcctttctaaaaattatgcacaaataagagagcttgtttttaaaatgagattgtcattcttagtgacagtaaagcaattgaacatgttctattgtaaaggcttatggcagcatctgttcgcttggtgttggcacagagtaattgaatgatgactgggaatctaaaatgtagaaaattatggaagtaactttctgaaattaaatattatatataattatttcaaagtgtcatacacacaaaaattataaaatgtgtatctcctagcctttcaggctttatgtagcaatccaggtaatttttctgtgaggggaaaaaacttatcttttgatctgtgggtgaatttgattaactgtaaagctgaggaattgtgtaaggacacctgccttcacttggaccccactccaacctggatcagaacttcttgggactacagtcatgagctatcaggatgactgtaattcagattagaacaaaaagcattggtttgttgttccaagggacttccacaggaaacgagacaagagtaggactgttaccaaaggagtagaagcatcaacatctgggtaaagaccccactgctcggggacatggtatttcccaaaatattggcaggtagcgtgcagacctaccctcaacccacataatccagttatttatttcagtcaamtttaaagaaatgcttatttgaagacttgtctgtgcatttgttcgatgaatgaatgtgtgatcgctttcttctctctccctccctttgtctccccagccgcctgtgttgggctcatccctttctgaagtccrtagatatgtttaagttccggggaccatctacagttggagatcgtcttgtcttcactgccattgtcaacaatacatttcagacctggtaaagtgagcccttaggctgctatgaagaaatttaaacttgcacaaatgtaatttttaatttcagcctggaggtgagtatgggaactactttagtgaaattccatttttttcatgcaattttcaaaatccrtgaacatatttttaaccctttgttctgcttggggccttttcacaattagtaaattgtgaaggactggtttttgtcttataagggtagccgtatgtcccaattggcccaagtaggacctggtttgtacctgtcatccctgcataattattaacttttcctttcagtcccagtgactagatggtcaatcaactcataatggacctggtattaccaccatgaaatccaaaccacttcccagttatttttattattcttgatacacaatgaaaagatttgatttagtattattttctttttaaatgtaaaaatgaatatctgtgtttcctgtctaatttcagtgtttattttttaattacagaattattgtttttagggaagaaaacttaactttggcataatttaagccctcccccacattgccaaaatatgttcttgaatgtatataaagcccttcctggcctttttcccacttgaaagtggggaagtaaaatggaaatgctcttaggggcttgtaaaaagcagcccattgacctgaaaatggattttaatagttgcacaggtttgctgataacaaacaagaaaacccaggcccttatcctcctgttgcttagaggaggtggcagcggtgkgcaaggagggcctgatgggtcaagatcctctttgcccamcgccctgcatcacccttcacagtgttgaagttggagttcgcgtggaggcctttgactgtcaggaatgggccgagggccgagggcgtcacatcaacagtgcttttstcatttacaatgctgctgatgataaggaaaatctcatcacgtttcccagaatccaacccatttcaaaggtcagttattatcacacgaggttcaatagccggacctgtgaatagagagctctacctagaatctcctcccaccggcaacaacctctttggctctttccctttggttttccctcttttcagcatcacaaagtgaagtgggcttttttcttttccttttccccccgatcactctgatcatttgttcaaatgatggaagccctgaagacctcacctctaccgggctacacactgctgtgggtaggatgtcaccttctatgtcctgtttctgggtctcttctctcacttccttaactctagctcttgatgctgtgccacgtgccaggttcatggaaaccatatctttccctcatccctaaattacctgattgccaatgttaattttttctaaaaactctgtagtgagaattaagtataattctggtaacaggaatgttaataatctccacttttgagaaaaggaagaaaatagctgcaaagattgcacctttgtcagtgcaactgccctttgtggattcagcacagagactctgacttgatgaagtcagttcatggagagacaccacatctcagttagcccttttgactgatttaggagaaggatacttaaggattatagcactaagatagtagatattttattttattttattgattttactttgtttttgattaaaggatgatttcagacgctatcggggagctattgcacgcaagcgaattcgcctaggcaggtaaggaacataaggtgtaatgattttatggagtcttcgttaatctgacaaattatataagagcccccctctgggtctctattcccacgtaacggaaaaagagaaggtctgatgtttcctggccgcaaaggctgactactgacttatggaaatagttcttccacgttgttccactgatatccatggctgatagaagttcaagaaagtattatggttattgttgtgtgctaaatgcagagaaaaaaactgtcatttaacactttaatttttttttccagaaaatatgttatttcccacaaagaagaggttccactttgcatacactgggatatcagcaagcaggtgatgttttgtgatttggagctcttcatataaaagtctcatcattacaaaaatggaaatccgcttgcctaactggcctaggctgtgcctacgcaggctatgtgaaaaggtggattatatcagccagtcatgtcaagatgaaacaaaaccaggctatcagttactgcttaccaatcggcagtttagccttgtttgacttcttacagttcccaaactgcagactcaggatgctctgccatcagatatgttccagaagcatggcacagtgccacctggtatctcaccgtgacttgtgcccaccagcttgcatttttataaaaacaataacaaagtagtagtcatttgaatatttttaaccattaaatgtaaagagaaatccaagtttacttattacacattgattatcagtcatactgaaaggtagtctgtctttgctcaggacaccaactaaaatgatactaaaatgatacgcagttgttaagtatacagttactttgtctgaattctgaattaagggttcaagataaaaagtatatgttacctgtagcttagttctttttacttttgtttgtttttttttcgtttttgcttttgtttttgtttttgttgggtttttttttggtatttttttgagacagagtctcactctgtcgcccaggctggagtgcagtggcgcaatcttggctcactgcaacctccgcctcccggtggcgggttcaagcgattcttctgcctcagcctccaagtagctgggattacaagtttgcactacaacacccggctaatttttgtatttttcgtagaaatggggtttcaccatgttggccaggctggtctcaagctcctatcctcaagtgatctgcctgccttggcctcccaaagtgctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccatgtattgaacacatagctttaaaaatataatatttctattctaggcatccctgagtgacagcaatgtggaggccctcaaaaaactggcagccaaaaggggttgggaggttaccagcactgtggaaaaggtaggacacttccaggtatttgcataatccatcgcccatcacaaacgaaagctgtggtggtggtggttctactgcttctactgaggcttttaagaaggtaacaaaatcttttgaggaaactgtttctaagacgcaaccatcttttcagccctgtctctacaagctggttgatttggagtccttcaaatatacccaacatgctcctacctctgagcttaggttctcacatcccgtctctccctccttctcttctccatctacccaaatcccacctgatctagatcaggacagatgcttctccataaagcctcaactgccacacttgacttaaggacttctttttctagtaactgtcatgacttctttaaaattaatttttttggtcgagtgtgctggctcacgtctgtaatcctagtactttgggaggccaaggcaggaggatcccttgaggccaggagtttgataccagcccaggcaaaacaatgagaccccatctctacaaaaaatttaaaaattagccggctgtggtagcagacacttgtagtcttagctacccaggaggttgaggtgggaggatcacttgagcccaggcatttcagcctccagtgagctatgattgcatcattgcattccagtctgggcaatagagcaagactctgtctctaaaaaaaataaataaataaataattggtcaattaattatacactatcttgtgacatttcttccacagctacctcaaattaatatttaagccttacatggaaatttaactttttacacatggtcttctttccctaagtacattataaacctcttaagaaagaggccttgtctggacttctttgtatctctcttaggacctattacagtgttttgcatgccatcaggtttaaagagacatacatcatttggatcataattttatctattttcagaggttttttaggagaccctcggaagytcatgcccacaataactagactgtaagctccctgagggccgatctgctcaccactacacccagaccataggagcgcctggcacttcagagatgctcactaatgccagcactttggctacattcatatttcagtatgcactgattttcatcatcagtgaagcagcagcctatgaaataggatgaccatatgtcctgattttcctgggacagctctggcttacacctgttgtcccatcataattattaacagtctcttggtgttccagtttggatgataaattatattgttactttacctttaaatctaagtaaattcagatgctacttcattgattcgtttcaactctgactttgacttcttctgaatgttttgtttttggttgtttccttttatgagttctctgtcctcattattaaatcctttagaagtcttccttatcccatttggatccagttaaatttctgtctttgcctggttcagtgatgcagaaacacaggtttaactaatgcatttgtttatctttcataaaagatgcttcactactttgttttcttttactattataaaacttacttctttcatcattgctggcatctgagcattcatgagcagcagtggaaagaacaaattcatgtctggaatgaactgaaagaacatatttagtgaagtcgtagaatatattaaaactgcagttctttgggagggtgtggcccaaagcatacccaaataaatttgctagtgttgtgggagagctatcaatgattaattcttcattcttatacagatagttactagaggatattgtataaagtaatattcttgtgttatttccattgaatttgaatttctcctttaaagattatacttatgataaaaatctgattttaaaaatctgataaaagatgtttttgaagagttttcctcctcttctctcccacgttttacagcttatatgtttttaatttcaaaatatgactctaatttttttctgycaccttttagtggaataattcttacaacacagttgtctgttaagaatcatacttttgggccaggctcagtggctgacgcctgtaatcccaacactttgggaggccgaggcaggtggatcacaaggtcaggggttcaagaccagcctggccaagatggtgaaacactgtctctactaaaactacaaaaattagacaggggcagtggcaggcgcctgtaatcccagctatttgggaggctgagacaggagaattgcttgaacctgggcggcagaggttgcagtgggccgagatcgtgttactgcactcaagcctgggcaacagagtgagactccatctcaaaaaaacaaaacaaaacaaaacaacaaacaatcatactttctgggcaggcgcagtggctcacacctgtaatcccagcagtttgggaggccaaagtgggtggatcacttgaggtcaggagttcaagaccagcctgaccaacatggtgaaaccccatctctactaaaaataaaaaattagctgggtgtcatggcgggcacctgtaatctcagctgcttgggaggcttaggcatgagaatcacttgaacctgrgaggcagaggttgcagtgagccgagattgtgcagctgcactccagcctgggcaacagagtgagaccctatatcaaaaaaaaaaaaagaatcatactttcctcaaagccgggtctgacagcatccacctgtagtcccagctactcgggaatctgaggtagaaggattgtttgagcctaggagtttgaggccagcctgggcaacataaaatgacttcatctctataaaaaaaatcatgttttttccaggttttcaatataaattagatggtaaaaatttaagattgtagtatatgtgatgaaattggatagggcttatggttttaattcrtttcatgtttcatgtataatgatagaattaattgtagtagtaatacaaggagcaaaatgtatattttggaaacatcacacaggtatgtgaaacagctgaagaataattataaggtcgtttattaacaagtgagagattacagtgcttaaaccataaaagtcagctcttataggcaattccaagagaagacagttatatagggagaactttagagaggaggccattcttacctccttgaagacagtgtcaggagtggattgctgagggagaaatagggctttctaggcagtgggtagtttaagccaagttctcctggtggaaattagcattgagtaggagactggcctgacaggagtaactttttatttaaggaagacctggggatgtactgggaaaattatgatgaaagccagaatgacatgaaccacttgaaaacctttacataggacagacccctagtataggaaacagaccagaggggagctattctcatggagccgggggaggggctgggcccagagctccgcccttccgacccccacccgcttggcccccgtggkcatctccagatacctccarggaaaatgaaggctcccctrggcttctgtaaaaaccacttttgccctctttaccacagtgtagtctccataacatatttgtcaatagatggtacaaaaattctcaaatttttagttgtttcctcttgtactgtttgttttttgagatagagtctcactctttgcccaggttggagtgcagtggtgtgatctcggttcactacaactccccctcctgggttccagggattctcgtgcctcagcctcccaagtagctgggactacaggcatgtgccaccacccctggataatttttgtgttttcagtagagacagggtttcaccatgtttccaggttggtctcaaactcctgacctcaggtgatctgcccacctcggcctcccaaagtgttgggattgcaagccctcttatactatttgtataagacattaaattcaaattcaaaaagaatcttattagaatgaaaacaatgatatcactaataaaatgttagcaaggatccagcagattttgannnnnnnnnnnnnnnnnnnncctgcttgctttaagcttcatttcgtagaatgaaattctccaaccatcaaatgataaagaaaacgtttgagttggcgtattagttcatcctcacattgctataaagaactacctgagactgggtaatttataaagaaaagaggtttaattggttcagggttccataggctgcacaggaagcatggctggggaggcctcaggaaacttacaatcgtggcagaaggtgaagaggaagcaggcacgtcctacatggctagagcaggaggaagagagagggggaggtgccacacactttcaaacaaccagatctcatgagaactcactcactatcacaagaacagcaagggggaagtccactcccatgatccagtcacttcccaccaggtccctgctccagcactggggattacaattcgacatgagatttggttgaaatcacaaatccaatccatatcagttggttacaaataaataaataaattgaatctctatattcccaaatgtgaaaggtaattcattttcttggagaattgttcctggaaaattttttcactaagcaaaagctggcctttattagcagggtttaaagagaaccaaaactaactactgcatttccttgtctgctttgtttgcatcaatatcattgatttatacagcagggcaacrgggactttctgctaccctcaccttctaggggaaagatcaaaatcgaatttgctcatccagtactgtacctgacattggataagtcaagtgagctctgtaagggcagaattcagtggtggttacaacttagcttgatgtttggtttggctccaggataggaagcagaagcatgtgactgcaacctggggagcagcmcccccagaaaagtgctgtattagtttcctagggctgctataacagaggaccacaaactgggtagtggacacattagaaatctattgtctcacaattctggaagctggtagtctgagaccaagatgtcagcagggttgcttctttctgagcctgtgagggacaatctgttccatgcttgtctcctagcttctggtgattttctgtcagtctttggcattccttggcttatagaaacatcaccagatctccacccttgtcatcacatgtgttctccctataagcatgtctatgtccaatgtccctttttaataaggatgccagtcatattggattaggggcccatcctaccacagcacaacctcatcttgactaattacatctgcaagagccccatttccatataaggtcagattctgaggtacaggaggttggggctacagcatatgaatttgggggtggaagggtagagamataattcaactcttaataagtgctcagcacaatattgcatcccactccatcttgttccaccagaatggagcatggctgccccaagggcagattaggactggcactatggagttcaccctggccacctgccctcagctcctctgagattgcagagccccagcaggccatcctagagccacttacctaccaaccaccrattggatgactgatgaatctgataatctctctggatatacaccaatgaaactccttcaactccccctgtgctgggggcaaagttaggcatgcccatgctaagtagggtgtgtctcaccagccacctggagccccatccstagttttcttggtgtttgataagtgctcacagcctcagtcatgtcttcctttgcaggctggatttaaagggaggcttggaaccaagttcaattggagaggttaaatggtgtaagcaaataatcacttgtttcctttctgagcagcttgtagttaatttctcattttctcattctcttattgatgatatttatgtttaaataaagccttctcctttacagcctgatttttcccatctgcttgattcctgcagtgaagtcctaaccccatatttgtttgttttctcacagcttgttgccatgggaatggttataaggtagcaaatttcaacactaacttcaaagtatcctgaaagagataaagaaaacgggaaggatagaaatgtgttcttagctgaacacacatctctgattattgtcaaaaacacagtagaagaaaagctcagagtagcaagggatgcattcatgcttaagtatatgtcaaatggctccccaggacaagcctcctcttacctaaggaataatgtgcattaggaaaccaggaactggcctttcagaaggatgatccagccactgtgattcggaaatgaaagggtgcttcgtgctgaggaaatatggtgctccaggggccctgctaagaggctgagatggttctagaagtggttgattcagttcctggatccccttggcccacttaaagacacgcctgacatcctgggaaagtgtcctaagctatagccttgactctgctcttttgagggagatgaggtgctgacctgcctagcagtctggtgatattttctttttttcctcagtagaggcagggaaacatcacaaagagacaaggagagaaaggcctaggtttttacatttttcatgagaaaaaaaaaaactgttgtgcaataattaaatagcccaccctcaagtcacatattgtttagaggacacgagactacagcatcctggacagacctctagacatcccagtatttgaagagaaattgccggggcttcaatttcatccaggaaataagatgccttagttagtgcaattggtctatgactacatatatatgcatatggtttctaaagtaaaagcatcagttttctttcgtaatttaatttttttgttgtcttttagataaaaatatatactctggaagagcatgatgttttatctgtttgggttgaaaagcacgtgggaagtccagcacatttgrcttatcgtctcttgtctgactttacaaagcgacctttgtgggacccccattttgtgtaagaacaaatttaaaaatttttctcaatcaaccttgacataatgtaaaagatgatctccatactgmagtccatctccatcgtccaatgtgtgacccattgtttaaagagtatttttagaagtttgacccagcatagcactttgggaggctgaggcaggtggatagttgagtccgggagttcaagaccagcctgggcaacatggtgaaagcccatctctataaaatacacaaaaattagctggacatggtggtgcatgcctgtartcctagctacccgggagacccaggtgggaggattgcatgagtctgggaggtcaaggctacagtgagccaagatcacaccactgcactctagcctgggtgacacaggagaccctgtcaaaaattaaaataaaaataaagtttgatctggacagaatactgcatcaggtgatattgagagacacaaaacaaaaattatactcacttatcatctatattgagttgacctgctttacacacatctattgtaattctaccagtaacttcaaggtcaatattatttccatttaagaggttctgagacgtgccaagattgcacaggcaataaagtgatggaacccaaactggaacccaagtctgtcatgctctgaattctacactcttctactttaatatgcaacctcattgctcttgaggaagtgattatccaattgtcctgcatactctcaatatttcattggcagttccttacttttctgtgaagcaaccctccctggtgagaagctaagagagcaagctgtgtgagccccgaggtgaaaggcatgccttcctgctccccctcctgatgatgtccctgctcctattagcctacatctcccactcctgccactccctgtctcctgcatccctaatccaatctcctccactccccagccctttcctggaacacagtacagagctgtgcaccctgccaactgcactgacagagaccagctgcactggggcccagccaccttggctatagcaccccgcagggcttcatggcccacyttgttgacacggaagagttgatgagatgggcttcctatgtgttaagcgtttcctaatcttgacaagatagaggctcatcttcaaattttctaaaactcactgtgatagagatttagaaataccatgtaacatatgatttaataccactaaagtgaaacatctctgaggtcacgtgttacattggcacagatgctagagttgaaatgggaggagttcccttatcctcctcatagggcctgcgacaagggtgtggcttgtttcttcsgtgctgctcaaacccctagagggatcatgcagacgcttaagtcgcttaagtcgtggggagtgtttttgagctctgaccccacggcagcatctagggttgactgtttatggcttctgaagccccggtgggtgtgtgttacgatgcgctctttcagttttgctgtctgcaggcagcctgtgttaatcagctcgatcagaccctctgccttattgcaagaacagagggctttctgtatcctggattcttgcgttagtgtactggaaaaaacggctcacgcgtggccttggaggatgggtgcaaggtttattgagtggtggaagttgcttttagcaagatggatggggagccagaaggaggatggagtgggaaggtggtcttcttctggagtcaggctgcccagccaccagactctcctctgaccacccctgactgaattccatgtctttccaccatcgatggtctgccagcgtctgctggtgtctggcagtgtgctcctctgttcctctcaacatccagcccgctagggtctcgggttttttatgggcacaggatgtggggtgcagtgggccaaaaggtaacttttggggtgtgaaaacagaaatgcctgtcctcatttaggtctgtgggcacaggcccgagggtggagccctcaccagggaccctgcccttccctacccaacatttccctgcccacctcctgtatcagaatgatacatcgtggttaatgctatcataataaatcattctgagagaagaggaacacttctcaattttcttgcatcaatttagtagatactctaccagtacaagcttttaggaataacaatgcctaaactttggtgwtatgctttaaaaatgtttctcccactatctctatgtcacttgacattccagccaaattgaagttgaacaaatkggggagtgaatgaatgaattctaatccaactaacttttcttgtacatgtactatgattcaggtactatgccaggtgttttcactgaatccttgcaataaccccacgtatcattatctaaattttacagatgaaaaaatcaaatgacttgcctaacgcaacttatgtagcgagtaagtggcaatctgggagtcaaaagaaagttgtgtgactccaaagctagtgcggtttccaatataccacatttctttatctatataaacaatccttcttggactgactatatgatttaccagtcctcacaatgtttttacttgatcctggagaaaaataattttgtgtaaaacagctcaatgcctttcactgaagtattgagaattatgaacttgaagtcagatggccaccatcctctatcacttgcagaattattccttctgatcaaagagctcttgcgttttttgtttgtttgttgtggctttttttttttttttaagatctcactgtgtcacctaagctggactgcagtggcacagtcatggatcactgcagcctcaacctctcaggctcaagtgatattcccacctcaacctctcgagtagctgggagtacaggcatgcaccaccacactcaaataattttttaaaaaatttttataaagatagggttttgcaagattttgcccaggttagtcctgaactcctggcctcaagtgatcctcycacctcagactcccaaggtgttaggattgcaggcatgagccactgtgcctaccctcaaagagctcttctaaaggcagacttgagcaataatgctggcttttagggagatgattaggtgagctgaaggggcaaatatggatacaaataatgagattatgtaagcaaataagggaagtgaatgcctgagcaggtagaaagtatacctgcttttcactgttctatatacacaggtcctgtgaagtcatagactgggtgagtgaagatgatcagctgtatcacatcacctgtcctatactgaatgatgacaaacccaaagacttggtagtactcgtatcacgaagaaaacccctcaaagatgggtgagtatatgcagtccaagtgttctattaatatttcatagtataggatagaaattaaaagttgatgtgaaaataatgaagtctgtgtagatatttctgctcttgaattatgtttatttgaattatacctagatgaatctttagctattattttaaaaattaacagtcatctattaagagccagctgtttgcaaaggacaatgcaagaatcctaaagtagttccttttcctacgtaaatgtaaaactggtattcagtaaacctttgaaacataccatgattagtaaaaatgtcgtggaagccaaataagacatcaggaattggtttagaattcaccaaggcttgactatgctagacatccaccatggctggttgtcagctggggctgtcgatcagagtatccagacatagtttttccatgtacattgaacttctcagagcatggcagctagcttctaagagaaactgtcccaaataatcccacacacatatgagtattaacagatgttcagtgttgtatcatttattatgtcaaaagatattagaaacaaatggaaaatccatcttataaattatggtagagccatactacaaagtattgtaccatcattaaaaaggatgaaggagctatagtgggactgatagagaaacaccttcaaagatttattgctaaatgaaaaatcaaattgtagtcaatatttgtaaaatgatatttatgtaaaaaattttgtgtgcatttgcttatataaatgtcattcttatacacttattttaaaaagtctagagggctatacagtaaaatgttaagcgtgttcacttctagggtagaaaatagcatgggagcgcaattggactggaggaagatttttattttgtagcctacagggttctctattgttgagagtttttcttttaacaacaatgggtattgtttttattattattattttagatgatgtgttgcccaggctggagtgcaatggcacaatctcagctcactgcaacttctgcctcccgggttcaaacgattctcctgcctcagcctcccaagtagctgggattacaggcatgcgccaccatggtcagctaattttatatttttagtagagatggagtttctccaygttggtcaggatrgcctcgaactcctgacctcaggtgatctgcctgcctcagcctcccaaagtgctgggattacaggcgtgagccactgcacccggcctgttttttaatttaaaaaggaaaggaggctgaaattacaaccctgtcgggcacaataaaacttcagtttggtggttgactccagtttcatggagttacacaaagcattgtatatgcaattctaaggcagaaaacactatttcctaccttgaaggtagcctgtagagtgttttctgatgagaccactcttctagaagatctgggccttcatagtttcacttctacctgtataagtaaattgggttaactatagggatttattttctaacaactattctttatttctcacaagagcttagaaagtgttttctttcagtaacacttacacagtggcagtgaagtcggtcattttgccatcggtccccccgtctccacagtacatcagaagtgaaatcatatgtgccggatttctcatccatgctattgacagcaattcatgcatcgtaagtttgatgaaacatctgcagattaattggctctgccagatagcgaaaaatctcttaatttacccagatgtcctaattaattgtaatcttgtaatttgtgtccacactatgggaatcctaaggtcatcctttsggatcatctattccagaaggtcccccagaagattagggtcttagcctcccctacaccagcaagactcagatcctttcttgaaaaagctccaagtcaataagaaattaaaatattgtactttctttttgaaacaggtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttcccacttttaattccaagcacccttagccctgacatctgtcaagctttggggccacaaaataatttaatataaccctaagcaaaatgcagtgacggagttaaaaaacaaaatgcatcttaagtcaaataccagtgatttggattagcattaaaagagctttagaattctgttgtaagtcatctgtggctctgcctcttccaggggcacagatagtggaaaattgcctgtatgcartactatgtgttctataaaatggcatgaatttagtttaaattatcgtaaacatttttaggttacagaggtgaaacatgcattctgtgtgaaattccaaaaaaaaaattataaaatctaaaatgatttgctaagttgactcgttgattaatgtatggcattcttcctcgtgcagcaggtgtctatatgtcaggagcatttgacaagatgtattacatagtctagagatttaaattagggagacattaaaacataatggaatccaatcaattttagtaataagaacaactttacttgtgtcatttaacatatattccaggtggctgaccaatttagtgtctattgctctaatagacacacaaggtacctgtaaaatgtagtattacagagaaagagaatattgaccgtgatctctttcataaccattacattagcactttattccgtagacttcaacattcagtattctcctctgtgatttgtcttaactcatgagacaagccagaatatggcaagctagcctcctctcaaggacacgttttaaaagttgaaggagtctccatttttggtgggagcacttaacagattagatgcatcctgctgttagtttgctaaagttctacctctgctccccctaccaaccctcacccatctattcacacaaggtaagcctggttataattattttcatttttcctgtgccagcaagttttcatttacatgaactttggactgttctgcaatttcatacattaacatttatatacgtaagaagagtggatatgtggattaaaataattatatattatattccagaagtagagatggttttgagaatatttttacattttgaaaaagtcaacaaaattagtaatgaaggagttacattaaactaaaatttcagacctcacctacaattgagacacttccaaatgctgtctgcctagcctaggtctttgagtttacattttttgaaatgttttcctgaacagtaacggaaacattgtgaagttaaaggagtagagtgatgatagctggatcactctgagacataaagatgttgcccactctaattgacaacagaggcatagtctattcctgcattccccaatatgtgtcattaaatagcactaggcacgtgtgctatttaattaaaattaaataaatttcaaaaatcaattctcccaccatactagccccatttcaagtattattagtcacctgtggttagtggctatcaaattggactatacaggtatagaatatttccatgatcacagaagattctttagatagtgctgttctattcagtttgtcccagtcttataataatgcagacaggtcctgttttcccattttcacctatcttagtgccaaacaatcccttctaccccttttttaaatatatttcacttttatgtttctgaacaaaaacataggactcatccacctggcgctttcttggatcattcagcatatcctgaattgaagagctcattttcaggactactggactttagaaatgctaaatgagcatggcaagaagataagatagcaatgcatttaggctctccttagggcatttccaaaagtttgaaatctattgtctaaaacaatgccaaaattaactaaggcattccagttgtaaaagttaacaatagctcttaagtttgcattttcctttttcttaggaatatactcactctttcattcattcagatatttattgagaactttgtgctagacacatcttaggcacggcgggttcagcaagaaacagaagcatactctgttcacatcataaataaaattaatatagaatattagaagatataaggaaaaattaagcagggtaaagatgaagagtgctggggaagggttgggggtggtggttgatattttaagtagggtggtcagtgtaggcttccttgagggacatttgagcaaaagcctgcaggcagacagggagtgggctgaggatctctggatgcagcatgcttcctaccgaaggactaggcgaggcaaagtccctaagcaagggagtgtttctggcacattctaggaaagcaaagaacctggtgagacttcaacagagcgagagaaaattaaagacagctgaattaaagaccatcttcccctactctctttgatgtccaggctttaagcaaacgcgtttgctccaagggtaagcagctaagttagttcatcagcagtcagccccctggaaactaaggacagaggaaacctagaaaaattagtcccactgatttttttctttggagtgtcaaagtatccttaagggacactcaaaatttcatgctgtttttttgatggtaagggttttcaagtgcttctaacaggaccgaaagcttcttgattaagaaaggaatctcagccagccgcggtggctcacgcctgtaatcccagcactttgggaggccaaggcgggtggatcacctgaggtcaggagttcaagaccagcctgaccaacatggtgaaaccccgtctctactaaaaatacaaaaattagctgggtgtggtgctgcgcacctgtaatcccagctactcaggaggctgaggcaggagaattgcttgaacctgggaggcgaaggttgcagtttgcagagatcgtgccactgcactccagcctgcgcaacagagtgagactctgtctcaacaaaaaaaaaggaagctcattcctattaattcttcctggtttcaatgcaatctagttactaatctgcattcggtttctctattatgtttgttttagaaaaaaatctagtgaaagaaatgtgaaaatgaatcagaatatagtttaccctgtactcaaacatctttaggaaatgatcaattttaataaataatggaaagaaactagtatatatatatatgtgtgtatgtatatatatatgtgtgtgtgtatatatattatatatatgtgtgtgtatatatatatacacatatatataatcacatatatataatcacatggttttgtttatatttcttattacacatttcagaaataagcttggacattttactggcatagttataaggatagtcttgaaatatatgttgatactatcatatttgggattaagttaaaaaaagaaaatatatgttgaaaaagacatataaaggaataagtcttgtgatttagagtaaattattaaaataagaactattaagtttgctcataatttatttcccctttccaaagtattaaaactatggggacagacagctcaccatgagccctgggtggtcttgcacattcttgctgagtgtgccaggctacaggactaatctgtctaccaattctgagcaatttctgtagctagtcccatagacaactaaataggtcaaggtgaccacagcatgattcagtgtaactgctcactctctgggcagaggaggcctggcttgtttgctgcctgctacagtgctcgctacttgctcaaaaagttatcggcctttggttcctcagctgtgacacaagcccaatatgtctgcagcattcactaggcccttcttgtcacctctgtgggacttggagggaaaggaaagcaacacaaatatgctgatacttatgctgcttgctgtgtcatgagtaatatagtccttcatctctgaaccaaaagtcttgtgtcttttgtcaacatccacaaaacaataagaggctaacttaatattaagactcttggccaggcgtggtggctcatgaatgtaatcccaacactttgggagggtgaggtgggcagatcacctgagatggggagcttgagaccagcctgaccaacatgaagaaaccccatctgtactaaaaatacaaaattagccagacgtggtggcatgcgcctgtaatcccagctactcacaaggctgaggcaggagaatgcttgaacccaggaggtggaggttgcagtgagccgagatcatgccaatgcactcaagcctggcaacagggcgagacttcgtctcacaaaaaaaaaaaaaaaaaaaaaaaaagaatctcagggctgggtgtgcagtcgctcatgcctataatcccagcacttttgaaggctgaggcacatggatcacttgagcccagtttgagaccagcctgggcaacatagcaagactccatctctatgaaaaatgaaaaaatcaaccaggcatggtggtgcatgcctgtagtcccagccacttgggaggctgaggtgggaggattgcttgagccctggagtcatggctgcagtgagccatgatcatgccactacactccagcctgggagacagagtgagacactgtgagacactgtctctaaaaagagaaagcaagactctcaaacccttcacagttattgacagtaaaccatctccagattcaaaagtcagagaaatctgatattaaaaatgcctttctcattttacacctgcaaggatgaagcaccctataaaaattatatacctgataccacctttcacatccaatttagggatattttggagatactgaaaatagattagaaaaaaagtatttttatcattggacacaactcattcccgctttacatgcccccccgtttccttgtccggcttagattccgtggtccatcattataatcactccctggaaaacactgcacctctgtcctttcattcagcttctctgacaaaaaccccaactatggctaaattaaactattcataatacttcattcctgcacacagcaggtgaaaattgtgtactggtctcactttaagttcgtgaccacaaattttaacagggtgcttaggaggctggtaattctactccatctccctggatgtttgctatttcacactgagtcctcttccctcaagcttctcgtgtctcttaccctgactcaggtcatgaacttcaaaaaatattcattgagaaaatataaaccatcaggcaggagtcttttcctattcccatccatgcgcctttcacytctttgctttttcttctgttataatggatgaaatatctctacccctagcagagaacactttctctcaccttctccaggactcccttccatcagttctcttttttctctgcttcaggagcttctttacctccactggattaattttcacaaccacaggtgtctcttaaaataaaacgatactttttctggatgcatttcctaaatcctgccccatgtctattccagtggtctatagaggtggtcttcacacctttattttatttacctaactatactcccacctccactactccacaatacttctattatcaggatcaactatgtcttttctattgccaaatctaatggccctgttcttgacttacttagtctctgagcagccttcagtgaagttgactccttgcttctttttgcaacattttctcttcttgacttccatgatgtcacactcttagaatccctcctacatcactaattccatttttaaagccttttcttgtggttcttcctgttccatcaggcctctcaatattaggttaccctagggctctggccttggcctcttctcctctatatctattcctcagtgagtctaaccagtatctgggtttaaaagccatctatttaccagaaattcccacatctatgtctctaggcttaatttctcctgaacttcatgcttgtatacttaagtacttatttggtatttccattaggacaatagtcatctcaaagtcagtatttccaaaacagaccacccaaattctgccacctttcccccaacaaattccctttccttcagcaaattctattggctttttgtcaaaaatataatgagaaccttactacttcttatcaactttaccactaaagccctaatccaaaacgctatcttctctcatctggattataacctatcttccctgcctggcacagtggctcacacttgtaatctcagcactttgggaggccaaggcaggcagattaactgaggtcaagagttcgagaccatcctggccaacatggtgaaaccccgtctctattaaaaaacaaaaattagccgggcatggtggcacatgcctgtaatcccagctgcttgggaggctgaggcagaagaattgcttgagcccaggagacagaggttgcagtgagcca

SEQ ID NO: 12387 - DNA, 61177 bp, Homo sapiens
attcaaccttaacccaaagtataaattaaatatccacaagtccttattgatatagtgattaaataaatcaattggaaattaaagacaaatttcccatgtggaggaattcaaataatttacgtagctactccaccctcaaggaggaggaacataactcctcactccataaatgtgggatgtacatagcatttccttccaaagagtgcactatgaaaaaaagggtgaagaaaaacaattaactttacaatggagaaatctgacaacactgctgagccaggtgatcaaagtcaatgtaaatagagataaatcatgttgatattatgtacctctgatgtaatgtggtatcaagaaaatagcactttacctctgtggtattcctcctccaaacttaacaacctcagtcaaatcatgagaaaaataccacaaaaattcactagaggaatatcttgcgaagtatctgaccatttctcctcagagctattacagccaagaggagcctaaagatacttgagaactaaatgtaatgtaccctggatgggagattggaaaagaaaaaaagaattaggtaaaaacaaaagtaacctaaataaagtatgaattttagttaataatatattaatattggtttattaataataacaaatcaactacactaatgtaagttattaacagaagtaactgtgcaggctatatgagaaatctttgtgttattttagcaatttttctgtaaatctaaaactgttataaacaataaacctattttaaagtaacatatacattatacaatgtgagaaaatataatggcaaaaaaagaaaatgcaagcacaaactatattccgtctctcagggataataattattaaggtgttcagtgaatattgttctaatcctttttctgtgctcatatgtatgtatattgtttaaacaagaaatctcaaaccatatctacatctgctgtttaccagactgcttcctttacttactaagatatggtaaatatactatatttacaagtttacatatttacatataccaaactatacaaaatacacacttttatagtattattttaaaatggcttcatggaattctgttgaattgatacgccataatttattgaactatttttgtcattaaccaaacatggtatccaaattttcactataccacaaagttccttgtgacaccatttttaatgttttttttttgtgcactttatgcctaactccacaagacactgttattaagagccagtgtgtttctccaccatactttctttgctcttcatcccttcttgcatctcagattttatctggggtcaatttttttctaattgaagcagatttttaaagatgtcatttggaggagtcctttactggtaaattttcagttttagtttttctggaaaatctctatttcaagtttatacttaaaagacatctttacagaatatatatagaatacttaattcacaagtattttctctcagcacattgaagacaacattctaatgtctcctaattttcattgatactgttaataatttagtagttgtctgcttctctttcttcttgaaaataatctgtcctctctatctagttcctttaaatatcttctctctctctctgatattctgcagtttaattatgatgtatctacttgtgtgtatgtgtgttttaaaaattatcctgcttaagacttattgagcctcgtgaatctgtggattggtatctgtgataggcagacaatggctccccaaagatcttaaatgtcttaatctccagaacctgtgatagtctaagttaaggttgtagatgaaattaaagttaccaatccacagacctcagggtaaaaagattatcctggattatttaggcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggtaagaaacaaattctcccctaaagcctccagaaagggatacacctgccaatactttcattttatccctgtgagaccagtgttagacttctgacctccaagagtataagacaataaatctgctgttttaagccactaagttttgtggtaatttgttatggtagctatggagaactgatacagtgcctttcaatagttcttggaaattcttcaaatatattccccaaatattgcctttgcaccactcactctatcctctatatctcttgacctctctttaacattttttattttcttattttggtaattatttaaaacaattggcttcttgttccacttcaaataaattcatatttttatatctacatattaagaattagttcataaatgtaattgttgtatcgtatatactttaaaaggaaaattgcatttatacttggatattattatattttaggttttgaaatttctttttttaaatgtctgataaatttattctgatcaaaattaaaatcttattgtatttacagtagtctactaaaagagtttacatcaattctctcctttaaatgctagcaattcagttttgtgtggtcaaagataatttagaatccttttatggtaactgatatgatacaaaggatttttttggttgttgtcaaatttgtatgtgcgtatatatgtatagggggtagaaaatttggttagtgactctattttggaaaaatgaatgttctttttggagttttagattcccagtgtttcaaaccaagtttgcttttgataaggaattcagtgaatctttattttctcgtagagaatttttaaacaatacctttcaaaatattgtatgtattcctatataattttgccttggaataaaaaaagtcatcacattaagaatatttttaacttaagaaattttttcaagattctttcaaaatgctaactccctcattgatttgaaaatacttttagagtttaaactattatgaccatgtagggataacttaaagtgtccttctaaatttttttttcattaatgtcatgcttctttctaagaacaaagtgtttcaatgttataaacagactgttttttcacatagctttcatacatcctgactttctatatctagtagggtaatacatttccttccaacctttagtggggtgaagttcatttgtcttctaatctaagaaaatacgttaactcctgacaayctctgacactcaacagaaacacaactgtactttggaattaatcatccatctttatttcatagtctccttatttatcaatgcaaatggaagtatagcaaatatttcacagtgtcatgtactacctaaggaatttcattgcaatagcattgttttgaaatgtatcatttgattttgatctaactatcatagatcagttttacccctgtatgttcagcctgaatgtctaaccacaatttcacaaaaatcaagggctctgttagttttcatacaaaattgtgatgacttattatgaagacagtcccaattaacaattgcatgtcatctgtaagaaatcaatttttttctcactccccacctgtaattttttttaagcaaagaagaatacttgggtctaggtttcaaggtttatttttctgtagtcctaatatcacttcagtaaattaatctgagactcatttttctaatatgtcaaatgactgttgtaaggattattataaaaacgtaaggtgattaacaaagtatgtaattgttccatagatggcagctcttgtttttttactgtgctttgcttctgccctgcttcacatattatgtaaaatagctggtgagttttaggaggtagtgctcacatgtttgcacagtgtttgctgtggacgatcaacagtaacagaagagcatacttcttcgatacacagagtttactgaatttggaaaggctttggcattcttatgtcatctgtaatgaaacaatctccagaagtcttttctaaaatgtccttgtaaaaagaaaaaagttatgtttatattttataaaaggatgatgttatttataaccagcagaagcagccttatttgaacatcttatgttgaaattgctacttaatacagtgactcataggagctttctagtggaaatcaaatgctcaaatgaaatagaatttagtttgttaggcaatagtgatatgtcttttattggttggactctggaaaacacttgacaacgaatagtactttacccgaagggcacgtatcatgcaccacatagcctaaccacaaacattaaaggtcttgtaactgtgagcctcaaatgaaaatacataaggacagctctcatacaatcaaatacaatacaaactagcttttaatttaaataaatatgtaagtaaagttcaagtgactataatgattttatatccctatgtatgtatcacagaaattgtggcaaactgtagaaatctattcaaatggaaagtaacaaagcactttcacattgccttgtattcaaaatccctactcttcataaaaacttatatttctttaacaaagctacttttctgtttaactcccggaaaacttcgtatttataacttaagggggtttctccaaccaaacaatttatttttgctaggtactatagctatattttttatacaaaatttgtgacagcaaatgaaattctaatcccaatagaagaacaaacaattttcatgtttcgatcttcatatatataattcaagaggaaatatgcttaactttgtagatttttacattttaaattgcattgtgtctgtatcaagtctactatcttttacctagattgtctggaagatttaagctcaaggttacggtttgagaaaagggttttgagagtgaccaggatagatttaagaattcattttatactaaaatatggccataaatatttttaaatacattcaaatagccctttgctggcacattttttcccttctttgccaaaacattcccacaggcggcctaagtcacctcattttataggtttagtaggtttagcaggctttatgtgctctagtagggttagtaggttttgttcatatcaggtctctctcatgggagtttccagggacaaggattgcttcagttagtatggccttagccatactagggtatttgctttaattctacagaagttttctaattaatattctgtagcaaaagaactaagatctggaattccccctcttaatctcttcctagaaatgagattcagaaaggacaggactgcatccagcctgtttgggaactcagacaaatgtgtgttgtcacagacacaaatagaggtctactatgaaataattggcttgctagtgtgctaatgacagacaatgctgatttgctccaacctcatacagtttcacacataaggacaatcatctatgtttcatgaaagttctatctactttaacattattttgaagtgattggtkgtggtatgaattaacagtttaaatttaaatcctaaaattcagtgtgaattttttataatagcataaaaattcaaagatgtccatacaagaaaaattaaaatttggttaggtttagcagagtttgagaatccttactaccctcccacatagtattgtaatgtgaatataggcagttactattacaggcataatgatgattatgtattaagcagaaagaagtatcaccaccagtttttttctttgaatgcccctcagtacttctgcatttataggatggtagactggtttggtttagctctcaaaagtgaaaacatttaaagtttcctcaytgggtgaaaaaaattaaaaagagtgagagactgaaaactgcagcccacctacgtttaatcattaatagtgagcccttcagtgaacttaggtcctgattttggagtttggagtctgacctttccccaaagataaacatgattgttgcaggttctgaagagggtcactccctcactggctgccattgaaagagtccacttctcagtgactcctagctgggcactggatgcagttgaggattgctggtcaatatgattcttcttgctgtgctttttctctgcttcatttcstcatattcagcttctgttaaaggtaagtttgtgttgccttttgctaaactttaatttccatctttggagttggaggcagatacgtgcgtgtgtgtgtgtttgtgtgagtgaatagtgaaagagtttctgactaaactatcttcaaaaccatgtaactttggaatgtttgtgaaagcatggctgagttgaaatgaaaaccaaattcaaatccctacaaacattaagaaaacagatatttcttttagtttcagttcctcagaccagtgtgttcttgcttcaatttctcattcatggtctgtttttaaaagaaggaaaaaagatacccactattgttacctgctgttgttggtcacattgaatgcagctccttcatttgaattgtaaatgaggattttttttaaaaaccgagttcttaaattttcttttagttgcttagcaatgtgacctcaagaagaattagacccaatgaaaaaggcatttgatttgccaaagaattatgaatgaaatggcacaacatatatttaattccgttacaattaaaaaatgatagaattcatagtgaattaaagaaaattaaatttcctgatacagatttaagaaataagacattatctttggaaaaataatgttgctacttacagtttctattttaagatgaaattaattttaaaaatacatatgaattaataccattgaaaaggcaagtgaaaaaacattttatgaggaatggtttcataaaactgttgtgaagtgtattaatatagaatcatgtttcagatcagctacattataaacatcggttttccaaatgctgcattgtgtaaaatgatcactttttagtttcttaggaagacacactgttaaaaaccaattgatataacaacatagcgttatagggaccaattttaaaaccatgtactctaagtaattgatagaaaacaattcacttataaacttataaaacctgttagggataaatgtggcttttgatattaaagtaaagtttgcctcaggattttttgtgtagaaaatttccacatgaggaaaaaaacctaatcttcattattggagcaatagagggttaaatttaaaccaattcacctcagcaaatcacactgtaggttcttgaactaaagaaaatattttcaccaatttctaaatatttactatttaaacatacagttcttacttggacaaaagaaattttttaatgagaagaagatttataaattatatctgactgagagtgttatatagaggacttactatttcatctgccaaataaactgttgagtagtcaaaatatgtgtgatttaaataccatagtatcaaacctaataccataagtattttgagaaaaataattgagacatggtacttatcatgagcttctcctgttttcccattttataaactagaacattgggtgacctcatgttttcaaatatacttataaaaaatttaaggccgggygtggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgmggcaggagaatggcgtgaacccgggaggcggagcttgcagtgagccgagatcccgccactgcactccagcctgggcgacagagcgagactccgtctcaaaaaaaaaaaaaaaaaaaaaaaaatttaaatatacacatacactagacaatggcataattgggaaatggcataaatgagaaaatgtggtttagaatattataggtagctacagtttattgtaaacaagcttagtagtaaatctagatttttaaagcttgaaacatatataatttaggggccacttttgagaaaagattacaaaaatatcttactattgcaaaggttactgaaaaagatatggcatgtggatacattgctagggtccacttctggagtctttggaaggatcctgggcaagagagcttaagcttcatcagcatcatggtacgttgcttatgctgatatcataaattaaaagtgtacaacttgagagcttctttacctagatggaataactttttgcattatggtaccatgatttaattatagattctttgcccttgtaacaactgacattaattagcaaacaacttgtgaagagtttaccttaaaatcagtccatttaaaatttggggatcccatgcctcattgcctcaaaactcatctctaaattaccaatgcaactgtttggtaaatcctcagatctgggtggatgttgaagggcaggttagaatctaaagaaaattgaggctgggtgtggtggctcatgcctgtaatcccagcgctttgggaggccaaggtgggtagatcacttgaggttgggagttcgagaccagtctgaccaacgtggagaaaccccatctctgctaaaaacacaaaattagccaggcatggtagcgcatgcctgtaatcccagctactcaggaggctgaggcaggagaattgcgtgaaactgggaggtggaggttgcagtgagctgagatcacaccattgcactccagcctgggcaataagagcgaaactctgtttcaaaaaaaaaaaaaaaagaaagaaaagaaagaaaggaaggaagaaaagaaaaaggaaaattgaatggcagattggaatctgaagagggtattaggattaggataaaagagcacatctatatgatttgctgtgtgaactttctaaagactcaagttttccctactttttcttaattatactttgtcatggttggactattttcagcgccttctctgtgttttccttatatagtatttttaccttctatttaattttgtcacctttaaacctgtacacttccttcatttccagtctttctctcaatccctcaccccacccttactttttagtcaatttttattaatcatcttccagttcttttttcttcttacccttcatcttcttttttaacttctgaccctttagttttctgttgggttcataaatgccattacctatcacccttatcatcactgcatgtctcttcaaacctcaccaataactcagctctgctttgtcttcttgactaagccagttatcagtgattgtactcatataaatctgacaaaggagtatttaaaaaatatttcttgaagattcaaaactaacagttttgttgcttttaagtcacttaaaaattctaaatgcacttgaagggcaaatgaaagagattctgacttttttggctaatattactttctgttttggttttatctaacaacagttatcaaaaaatrttactatacatactctgaagagcactatcctacaaaaggaattaagtcaacaatataaatgggacatgccccaatgcccagtgttgccagatctctgcaaagcataaacagagaaatacttatcaaaaaggaaagtataagaggatgacactctagcacagtccaccttatttgaaccgttttaggctttatctcctgttgaaagaggtaggaaacagtttggaggaataaagggcccattcttttctgtgctttaacatttcctactcatagtcaaaaattgatttattatatggccagtaaagtagaggtaagaaaagaagtgaataacataatagtttggaaagctttggaatttaagaaaggttaccttcctacaaatgtttcgtagttattttaaccagaggacaccttaatatagtccacagaacttggattttggtaaatttaaacatcaaatctgcattatatttgctatgttgggttgaacttggggtcagcttctatctgctgtcacacaatgcttacttttcagaattgctctgaggattagataagacaacatgtatttcctttatgccctatgtggaatttgataggtgtcataaaaagaaggcctcctgaccgaaatatttttcctgaccagaaagcyagtatttgaacccgctatagagtccccaattacaatgcagaagacatagagataagagggaatcccagtcttcatccccttcaaggtttttcctgactctctttgccttctgtgtctcacacctcagtttctgcctgacttggtgcttggacacagcttggttttgtgtatacacatagatcctttcatacttccttctcctggctcttcttgattcctatgaaaatgcttgtcccttttctttgaaggttcgacagattatgtgacttcactacccaaaattctatggcagcgtcccatctcactcaaactccccaaatcttcctgccacccatagrtacctcctttaccttgtctccttcactgtgtcttttacttatttatttccagcctctttggtctccctgctcttcctccattacacctgcaggagccctcctcggggcctttgcacttgctgtttcctctgtgaggggaaggggtagaaagggtaggagttgggggagggggatgcccttcccacagatatccatgtagctcaccgaaaacctttgtccaaaatgtcacctttccacagaggtttttctctcagcatctccattccctttcctgcttcagttttctttatgagcacttctatcatactatataacttgcttatgtactcatttttttattgcccttctccatcgcatttaaatgtaccttccaatttacatttacaaagggtagaaaatttacaaagggtattaaatttacaaaaggtagaaactttgtctgctggttgggtgcggtggctcacacctgtaatcccagcactttgggagggtgaggtgggtggattgcttgagctcaggagttcaggaccagcctggccaacaaggcaaaaccctatctctacaaaaatataaaaattaactgggcttagtggcgtgagtgtgtggtcccaactactcagaaggctgaggtgggaggatcacttgagcctggagatgaaggttgcagtgagcygagatcgcatgactgcactccagcctgggtgacagagtgagaccctgtctcaaaaaaaaaaaaaaaaaaaaagtaaagaaagaagaagaaactttctctgcctttctctgcttgttaactggtgtagtcccagagccttaaaaagtacttactattcaacaggtactcactatattctagttgaatgaatgaataaatttctagctcactgcctaggaatggaaaataattcaacctatagttttagagatatatagtatagataagagcatcatctttagagacagacagcctggattaaaatcatatctccagccagacgtggtagctcacatctataatcactttgggaggccgaggtgggtggattacctgaggttaggagttcaagaccagcctggctaacatggtgaaaccccgtctctactaaaaatacaaaaattagccaggcgtggtggcacacacctgtattactagctactcaggaggctgaggcaggagaattgcttgagcctgggagatggaggttgcagtgaactgaaatcgtgtcactgcactccagcctggccgacagagtgagactctgtctcaaaaaaaaaaaaaaaaaaaaaaaaaagaatcatgtctctatgatgaattacctgggtgaccttaggtaaattatatagtttctgtgtcccctcagtctcttcatctataaaatgagactaataatagtgcctacctcattagatttttgtgaggattaaataagttamtacatgtaacatgcagatgatggatttttgaccaccatttcctctgggcaagtacgtgctgtcatatgtagaggagacagtgaacagattgttactgtgtaggtgggtaaggccttttcaggcattgcaaagtaatttttgctatcacctttctcagctgctttgcttcttgtctagtcaccccaaaccccttttctgtccctctccccatatgtatatttcctgagagaaaaaaagattatggttgcgtgtcatagtaaactgggcaatgcaaccccattagcattgaggaataaggtaaactgaagtcttttttaactatctcctgagagccatacatagaaaatatacaaaagaaaaaagatttatgtgaccatacattttaagtcatctctgggaaagacttgctccttggcatttctttgggctaggtaaactgaattggatactgtgtgaactcattcatacatcagttttcttggctcacagtacagatttgtatactatttgatctttttaaattaccccatgccaactttaagcctgtactaagatttcatatagtaaaacattattttattcgggcacagctaatttaaagttacatatgtgcaacgctgaaatgtacctttgtactaaaagtttgataattacattaatagagtaaattacactgaagagatgtttcttaaatatcaaaaatgtccaaattaaagaacttccttctaaccactaaaactaccttggcattgatctgcttgcatttaaataatacgttaattacgaatggctcatattaaatttatcaaccaattcctggtgggtcctctacttgaaatcatgttcatataattaagagaaatacaatggcatttaaacaaaaaaaaacccaaaatatctatagttcaaccatggcactatcggataagtgattaggaatacaaactaaggttctctgaaatgggagtttatttgtttgttttttgtttgtttatctatgtttttcaagtcaatgatttcagcagatgaagtagcaccatgtttcaatcagcgaatatttaccaagcttcctgagccccactgtggtagagagatgcactgatggtgagacagcatgttcccttacaatgaaaactggatatgtgtcattatctttatgcaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacggtgggcattttctaccagataaatgcaaagattagatatcagaagtttttgagaagtgtaccattggacagcacttgtattgggttcccgtttataaatccatttagtttcttatctatcactaaaacaagcagttctatgtatttaaaggttttgctgatgaaaagtgaactgatctttccaagttattgcaacagacaatagaaggtatatactggtaaacgaccagagtatggtgttcaattctatagatcatgttaatagggaagttatactagagtcttttcaaaatgttctgggagagaagggtcaataatccatgttgtatgaaaaacaatttagaccactctaactcaagaggagatcagttaggaggttcctgcattccttgatacaacaggtggaattactgaagagagagtaaacctagtctgtgttcttcctgaggaaggaaccaagtactcccctgaataacagtgtttggtcagttaaaatggtttagatttatgtgytgagaagggaggccaaattagttggtctctggggacttttccaattgtaatatatggtgattcccttatttgcttctcaagaacctaaagataatagattccttgagtaaagtcagttattcttctacatcttggtgtgaaacaggtacacaggacaaagtacttggaacaagtagttgctggtgtcctttatattgaggtgtcatagcaatacatttacaagtgatatttgcttctttgggtgtctctaattgctcttgtgttttccaagttagatctaagcatcatcatccatctctctgagccatttctcaatacaacagtaaactgttctccagaaaacattatattcctccttattcagtaattagactttatttttatttacacagataaggtagaatagggcaggggtcctttccaacaagtggtaaagaaagtgaagtgatcaggtagacagcaaccacaaaaaacaaatgaagagtggcaatgataggaaagaatcacactcaagtcacaattattttaagcctaaagtcacagagttctttaagtattgctatttttgccttattaaaaaacctagtttttaaataccttctccattcttttaaagtgagtggcaaggtcctataaatcatgaattgaaaaatgacagaagaaattgtggccaactctttctgtttctttatcattttattttcagagatactctgatgaagacagatataggaagttttttttaacagctttctttctgttactccagatgaaggatgtaaatgttgaaaatgtgaatcagcasagaggagasaagagcatcttcaaaggaaaaagcccatctaaaataatgggaaaggaaaacttggaagctctgcaaagacctacgctccttcatctaayccatggaaaggtaaaggggcgtttagattccacaactttttctccaacttcatatttttcttcccttcagtagatattattttgaggtaatcacattgtaactacttttatggtaaatggaatttcttcaagaactaaagaacagaggttgtaaattaaatgtttccaaactgaatcaatgccctgagttcccttacatttactagccaatttgtttcctatttttctggaaatctttatagtggaatgaagtatttatttattgatgaaaggcattattaaaaggtaaatttctcatcaaattataagggattacaaacrtaatgtaacaaagcaagtcatcaaagcatgattggatgaattyaggaaaggagacaaattatgagactgaaatgatccaactgagattagtaatattgatttgttatgagattatcgatatctggctaaagtacaaggttaaagattttaaragggtatgacaagtctaaagtagagtttttttaaagcctttagaaattattttaaaactatgacatggaaaagccttttatatattaaaataatgattgaacactttataatatatatttgaaaatctgttttaaaaattctatgtgtgcattacttatggcttgattctagtcaattgaaatggtctwaataaatttggaattgagaaacaattgtgatcagttgattattaggcattacatatttgtgtttatgaaaattacagatagtgtgttgacatacataaaaatgtgtctaaagatgagagctcaattttaggaacaaaagcaggaaaacagaaagggaacattgagttataattccatacgtctctgaaatttcactttctaaattcaaaataaagaaaaactgatctttatatactgataaagtaatactttatttattttcaactgaagtatttgaaaacaaatactttggacatttcatatatgtatattgctaatcatgatgcacatttttatatgaagttctaaaaaggaactcacaagaagaaatcttgtgttttcacctcgcctacaaccaaatatgaatcactatcttcaagaatgctttctcttccttctttacttgtcaaaatacttgccatgtttctgactgctcacatgccatttctgtcataaagttcatacccttccagccagctggaaataaccatcactctttagaatgctcttagcactttgcagctcactcatgacccttatcactttgtttttggtcatttgtgttcattgctagattatgggtgttggatagaaaaaaatccaattcctctttgtatttcagcctctccccttcacctccatgcccttccactccctccttccccaaagcacccagaattatgccttgcactgaatattttatgaagccttctccgacatctttccaaacccctgggcctatttctgtcaaagcgtttatcacagtgtattgtcactctccttttatgtcttggctctccacattcagaataagtttctcatgggcagagttgtatctgtctattcagcaccttgctcataggggatactgaatatagatgcttctaaaataaaggataaacaaataagattatatggggctcaactgagttgaactttgataaaggttttacttattgtttacttaataatagctaaaatgaactaagcacttactgtgtgctaggtgctgactaaaggcattacacgaactgtctcttttattcttgtaatggccctgagcagtaagggctgccttatcaacctcttgtgatagatgaggaaccaaagttaagaaaagttaggaaatttgcctatggtcatacaactggcaggtggtggagttgggacttgaaatagagtctatgctcaaacttctatgcctactgtcttccagctggaaagtatttggagaaatgcctgcctctttggttgacttgtagtgttccttatttacatcatgagatcagttgacttatttgattttcttatggctcaactttgttaacaacaagaaatattgttattttcttctctgagcttccaatgtggcaagacacttgagttcatagatattatttgcatttataatcttactgacaaccaatcattttatagctcctttggtagcagctgagtacaaagtcttctgctacacacatgaaaggactcagtaccctcactgttcaaaggctgggatggaactgccacatcattattttaataactgcaatgggccaattctagaggagctatgatttgcgatgatttactgtaaccacaggttaaagtacatcattgtatctttcaagtatataataaaatatttgttggaaaaaacttaacaatgaggactaagaagccaacaggaagttttggccatgtcactgtcagaaagatcattacttaaattatcatttcagtttactatgagagaaattatggacaggcagagtaaggctatggacaggctattttcttagagagcattttctaccacaggctcaaattaagttgtgctcctgaagtttctgggatttcaaggatgctcatcagcatgtaatttttgtccttccagacctccccctgtctccctttcccatctgaggctctcatatttacattttaaaagagagtccattaaaatacttagatacatattcattgcacatcttcttttttccatgcccactcatcttccctacataagtgggcataactctagttttgtctacaaatcattaagttgtaaacgtgacagttatctgattacgttgattaatgctgacgagtgaaagatgcctcaagttataccatggattcttttttaggcctgaaatgctgctccaattaactggataattaccagatttccatttctggttttggctttgtgttgattaaattaaccacgtggctgctgagtcagacctttattttgtattgtttcygggcattgatttgctctctaaatcascatggctcttgtacacacactgaactgccacaagaaatgtgacaccttgaaagtccttctgaaatttgttgtatatttctttacttgtttgttctccagtgtgtcatttcctagccatgctctgtcttagatagatatcaaagataaaattactaatctttgtttgctgggattctttttattatttttattgtttggccacttaatggaatttagtctcctcttattcytaaaataaatataaaggaaggtgtggagaaaggcatcttcttcctaaggaaaaaacaatatgaatgatgcctacctatttcaagaggaaactggcccctcatatttggctggaagaggcactgtaccaccttcccagccattttacccagtctccctctagctgtggtttccttgggttaaagacttcgtttgtaaccaggtcatacctgctgctgctctttggaagctctgagtactgtaaatttagataagaacctgtgctcttggatgttcagaactaatttcattgctgaatgaagtaatcaactttatggcctgagtataataaaacttactcagttcctgttgtgaaataataaatttaagattattgctgtgacagccatgtggcttgaaatgcaaaattctgatttcagattattattttttaaatgattacaaggcagctcaattctaacagttttgacatttagctggtatggatatcagtactatcttcactttggatctcatcagtctacactaaagaaacagaatttaggccctagaagtagcagtcatataaaagaaaaagagatgtgttcatttttctagttctggggaagcaataaaaactaatagaaaggattaaaaaaacttttttcattgtgtytcacagtttatrtctatcattcagcctgccaggagggaaaaaaggctctaacaccattttctaagggatccagaggtcaagatcaaaacttgatccattgcagtgggtcagtaacagataagcactgaaccttatgcacagtccaaagattaaatccaagaactgggtttccttaccttttaggtaaaactttaaaaatagctcagatacattttgtagcctggaaggaaagtgacatagtggtgacaatactggtatttttcccacttaggagatcttgctttctaaagtatttaaggttcataccaaaaagacatgggccatatagacatgtgtgcattgccactgagtgaacacttctgactattttggggcaatctagttatgaacttctaatggtcatgatacctggagatacacttccaaatatttgaaaaggaaattacactgtgattattagaggaaggagatatagtttacaaaatagaacttcagaaactcaggcttgggtctgagatattgccagtgatttgtttgagaatatgatactgtgaattttcagacactgaggtcattattccagttcctttctaagtcggacaaacactattccaacatttataggttagtccagtctaatgactaaaactgattgccagataaagtacctagtaaatccatcactaggcagagtatatgtaggaagtaaaaatagagatttgagacacttgtttggataattcaggaaaagtattctcttcttctaaggcacaagataattttcatgtagactaaattactgagcttggtattatttggattcattgcatagctattgagctttatgttttactttagaagctatggttggttttaaagagtactaggaaggcattcaggatatttctggtagaaatgctcagctataattatcatagaccttgggaatttttacagggaacatgtatctatcctctatttctaaattgtgtgatgcatatcaagtctacagggtgaaaaccaacaagctgattttcattaaattcactttgtacttttatccttgtttcttaaacattagttaaattatcaaaatggcaaaagacacttatcatctctgtgcctataaatatcaaagatgataaaacaaaactaagtggcttactattcctgccaaatcatagtcaccctcctcatttcaacctcctttctctgccttctgatggtaacctcaaagcagtgcctggggcaggttatgcagcagtagcaatctcaacctcaaattttccagccttctgaatatatatatacacacatatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatgttcatatatatacacacatatatatatgttcatatatatacacacatatatatgttcatatatatacacacatatatatgttcatatatatattcatatatatatatattttttttttacccaataccaatataaatgctctggagggtggaaaacattgcccctgtgaaatgttgaccatgggtattatggccatgcctggggccttgcaatagcccataaaggctgtgccatctcaggaatctcaaaggtagtgattgccattttcgtccaagaacttttttatttgctattattttaaaccttagttattttttgtttcaagtacagttacaggtagagaacatgctgacatgttcaaacagaatkttcatcatttctcttccctgggccatccttgttttcatgaggctcccagcctatatcagtgctctctcccaatgctgtgcccatcatgcaagagccttcattatcggtctccctaaacttcatattctgatggtctcagagatttaaatagcttcttttcacaaaaaggaaattccagatttggagtgtcagatctctttctcccaggattaatacaggtaagaatctgaccttgcctgacacttatttaaatctgataaatgatgcatttttgctycatttgtgttctgttcccctctccccaccaggtcaaagagttctactcatatcaaartgaggcagtggccatagaaaatatcaagagaggyctggctagcctatttcagacacagttaagctctggaaccaccartgaggtacttaccaatattaataaggattcagcatctcaataaaatttgtaaggatttctacttayacaatttcagtagaagagttactactaaggtaatgctcagaaaagrtgacttgtgtagtgaagtcgcatttgcctatgaaacaattgccatttatcccaatgttttgttaattaattacaaggtagagaggattagaaatatttatactaaaggagcttcgtggggatcattccagtggttcccagatatcactgtgcaccactgtaccatggaggggcttgttacaaatatagattccctatattcatcccagagattctgattcagtagatcggggaggaccygaacgtctttttttttgagatggagtctcactctgtggcccaggctggagtgcaatggcgcaatctcggctcactgcaacctctgcctcccaggttcaagcgattctcctgcctcagcctcccaagtagctgggattacaggcgtgtgccaccatgcccrgcttgtatttttagtagagacagggtttcaccatgttggccaggctggtcttgaactcctgacctcagatgatccacccgccttggcctcccaaagtgctgggattacaagcatgagccaccgcgcttggtcaaacatctgtattttaacagtctttgtggattatttggatgcattgtcaatgtagggaaccactggtctataccaacactgttcattttgcaaaagaagaaactagagaagttaggtggatcttccagtatcatacctggagtcaaggctggagtccaagtttcttagactgaattcaaccagcccatgagtgggtgaaaaatctgatggtagggttggaccaaaagaatgttggttagcttgctagaaaagagacctctgcttctgtgatgctggcagaggccccaggaaaaagctcagagaagctagacagagtctgtattgggatacatttgcctaaactcaaactgatgatgtagctaatgatgatttgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttgtctaattttaattggatttcgagagaagtaggaaatcccacattatttgtgaaaaaaaatgagaaggcgctattaagacactcaaccaaagagaatgggagggaatcaatgagctaccagaaaccttgttcttgtctttgtatcttatcatcctgggggagaaaaaaagtcccctatggcctattagagacctcaattttcaagccacttctcactagaattcaaatggccyacaaggaatcccaagcattatgcccttgcctttctttttagrtagatatctctggaaattgyaaagtgacctaccaggctcatcaagacaaagtgatcaaaattaaggccttggattcatgcaaaatagcgaggtctggatttacgaccccaaatcaggtatgatagatgtcactttctttgaggcattaaaataattacattttgtagagactaatttaatgtaatagaaaaataaagtagaaatagaattttgaaacatttgtaatttttagtttaggctacaaattcacacatatgtaatgaatagacccatttcaattgttgtaggtgttagtaatgagggatgggtgtaatggggaagctgtttgtagactgaaagacagtttgctatttgacttgattcaataatttaaacgatgattacttgttataaagatggctatttatttatttaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcatagagtatacatacacaaacctagatggcatagcctacactacattatatggtatagcctattgctcctaggctacaaacctgtatagcatgttgctgtactgcatactgtagacaattaaacacaatggtaagtttttgtgtatctagacatagaaaaagtcagcagaaaaatacagtataaaagatactatgtaggtgtacctttattcataaaaggtacataagtgaaatttgcagggctgaaagttgctctggatgaatcaccaaatgagcactgagtgaatgtcatagactaggacgttactgtacactactgtagactttataaacactgtacacttatgctacgctgaatttctaaaaaacttttttcctccatcataaattaaccttagcttactgtaatatttttacgttaaaaactttttaatttttgttaacttttgaastactctgtaataacacatagtttaaaacacattgtataggtgtacaaaaaatattttttctttaaatctttataagcttttttctatttttaaattttttatttttatttttttcttttaaaaatttctggttaaaaattaagacataagcatatatattagcctcggcctacacaaggtcaggatcatcaatatcactgtcttcctccagtggaaggcacttacaacctccaaatgttgtctcactgaaaggtcttcaggtgcaataacatacatagaactgtcacttcctctgataacaatgccttcttctggaatacctcctgaagaacctgcctgaggctgtcttacagttaatttttttaataagtagaagaagtacactgtaaaataataataaaatgtgtggtataataaacacagaaatcagtaataatcatttgtcaccattatcaagtattatgtattgtacgtaactgcacgtgctatacttttatataacagtagcacagtaggtgtgttaaccaccagcatcgacaaaaacacgtgagtaatgctttgcactgtgatgataggacagctatgatgtcactaggcaagaggaatgtttcagcttcataattttatgggaccacctttgtacatgggtccatcattgaccaaaatgtccttgtgcagcacatgactgtatttattgtgcttcctcatttcaactgtgagctccttgaaaatagtgattatatcttgttcatctttattttttacatcatctacaacaattcacggcacatggtaaataattactttttaaataaaattgtattaaaaatcaattatttattgaacaggttttaagttttaaaaagacaaactacttgattcattctagttcattttctaatttctctgtcaaatgtttttaatattaaggtaaaaaagtggtagcatttgtaatttttaagagtttttaaaaaaaattgttgttaaaaaacataaaaagttccgtagtgaagagatgtgacaaaatttttgatatgacttatgcaacttaaatatttaggcctgtttatcatttgaagaccattctctggacagaattgttctaacaggattaagaactagaatgttaaatcttagagtttctgttattttcagattttaattcagaaaacaatgttttctagcagtgaatgtgttataccttatgccattgcttctcaaaaaatttctctggagtagctgtaatattagcaccaaatagatgcaaaatagtagtaaaaatgcctgattaaaatgcttgaaattttatagaagtctcatctggaatagaattttgcattctacttcatatactactggtatatctatagtgttttattatattttcatataaaataaatattttaaataacttatcaggcctatgagatttccattgctatgtaacaaccccagatttagtggtataaaatgcaacaatcactgtactgttctctgtcataatttacaggcttgccttggccttgctaggcatctattatgtagtttcagacagtcaaactattcaaaggtggttcccccatgtatctggtgcatgggctggaaagactcaaacatctgaggctcctcatgcaactatctttatttccctgtcgcctctcagcattgcagcttcatgtcagacttcttatgtagtagctcaaggctccgaagcacatgtactgatagtgtgccagagaaaagctgaattctcttttaagacatagccttagagatcacacagtgttactttcagtctcctctattagttgaggcagtcacagagtcctacccaggttcaaggagagggatgtagaccctaccttttgatgacagacaggttctggaagagcatgtcagacaaaaatagagttgagactatttttggaaaataagattttctagctgtcttggttaataagtaacacgtggttgtattgacgatatcattttcagaaagctgggctaaattcaaaagarctgacattgcatatcttattcatcatccaggcaatttttcttccctgtatactgttgaaataatattttgaaaatgcaaacttaaattttcaaatcttttaatataattgttgcyccagaaagacttcataatgagctttcagttacctctggagatatcacagtttkaaagacrtggctatatacaacttgaataaattactatcttgtttgccaaaagaatggcaattagtatcttgttcactcaaaagaatgattataatatagcatttccctttggtattatgcaggcagaaattagagctgaagacaaccgaagcaggcccaagaytgatgtctggaaagcaggctgcagccataatcaaagcagttgattcaaagtacacggccattcccattgtggggcaggtcttccagagccastgtaaaggatgtccttctgtaagtgcagacaaatatgggaataatcatgacatcagactctgttttcattttgtctccagtgaaagcatcaactcattcaatgaagacagtttctaaagaactaccagctaccacagagttgtgatgacagcagtctcacaatatgcacctgacatagtgcatgacacatcaataattaacaaatagttaccattcattcctctcaaaaagtgttataactcaagggcagcctttaataagtcacatctagaattcagggaggatagagggcttaatgaagttagggggaagcatatggtgtcaagaatgtggacaamggctgaaccttgaaagttcwgtcacataatagttatttgtccacaggtgacatactttactggcctcagtgttctgattattgctgcaaggactgaaaaaggataccaggatctttgcctaaattaggaaacatttatttaccccagtttcccctacaattcctgtcagaaatgcgatatctcatccccagggcaaagtgtagatcattgtaacatttttaatccaacaaagaaaattttccttttattgcatgaatcagttatgatatacattcagagaaatgacttaccacccagmatttccttatctgtaatctcttgtcagaagagcaaaccattggcttcatgctctgtgtgtaactatagggagatgctctttccttcagtattactggtgttcagaaaagtgaaatcatcaagatgtaataccataatttgcttaaagtacaagacagtaattgcttattagtttctgaaattgagttagaggaaaaaggaaacattttaaaacacaaaatcatcattttcaaacattgtttcttcttttacctgttttttttttcatatgtcatttaatgttctaatgtaattttctaatgctgtatgagatggaaattatttaggaaggtggctaataaaactaawcttttcttatgctctgcactattaatttctctcccatagatattaaacattatgagccatctaagatttttgataattatttcttaattattatagaaaatgatttatttatgttattgaggaatttgcttttccaaatttggaattccaaattccaaatttgcttttgtaaattctattgcagccctttaaagtaaaacaaaaacaaaaacacctgaattcatattgatatgctctctgccttcagaaatgacccagtaaatctttagctaagtgcagctggaatttcacttggaatatcttcttaagattacatagytaaaaggcacttgaaaaagagaaaaaaaaggatccattgcttattaaaagtaatgaataatttaaaaactggcagcaagttattactatagagttagagagttagtagtcactgataggatttcataaaactaggggggaaagtagtaaagtatgaaaaataagttcttcagttagtttcaaagccgagagatgctgttaattagaactatttattaggttgttgcaaaagtaattgtggtttttgccattacttttgtgacaacctaatattatttttaaaaccrcaatagaataacttagtgtgtgtgagaattacctttatctaaatgctactctaaaaaacatagatataagaaatgaataattcagaccttagcaacagcaaaacattgaattttgtacaaataataaaataaagagagagaatagggagctcaccgaaaaattgattttcagtgaggtgcaggtaaattagaaacctgatgcaattcttcagcagttctcattattttatctctgaaatattttgctgttaattaaagttctgcacaatttaaattgcactatggtagtcaaagcctggcctcggataaattcccttggtgtagccgtgaaatgacctatatacccagaaaccagttaattattgccctaggatcttcaagctaaatatgaatagacaaaaacagtcctcctatagaggaatggttcacagagtggatggaagtcccaggggtatgatatgggcagggaactgtcatgtgtattgaggtaaggtacaaaaagctgctttcgcttcagacacaagggacattttattcctaggagaacaccctttgtaaatgtggatgttcacagttatgagtggggtatgagcctgcagtgtatgttttgcagctctcggagctctggcggtccacmaggaaatacctgcagcctgacaacctttccaaggcygaggctgtcagaaacttcctggccttcattcagcacctcaggactgcgaagaaagaagagatccttcaaatactaaagatggaaaataaggaagtattgtaagttccccaacctttgtgtggggttgtctgtcagaaacatttctggattgttggttttttgaagtaagaaagaccccttttaaaccaactgccccaccwccaaaacaattattttcttgtactacattttcatcgaaaagttatgccacagtgcagtaatttaatggtcacttgaccagaaatacaatagcagattttcagcagggactaggaataaacatgttgttgtgtttatgagtttaaatcaggactagattggtacatagataagtgaaggcaaggcttcgtcgtgacatcgtggggcatgtgctgcctcgctgtttttgaaattatgttcctcatgctgttaattgacacctgaacagatttgagttcatttaaaagaaaacaacaaaaagggtttgacttcttcagttgaaaatgtgatttcactaaacagccagttgaaactatgttttatgtaaaaaattgagaactgaggcgaatggtgaaaagaatctggagaaaataaatccatatgttacttaatatttggtgaaactatgatccattttacatgtgtaataaacagagttgacttaatttttccccaaaacattgcatctgtttctaaatagaatgtatttttagtctatcatacagaatttgtgtatatatacaaattgagcttatgataccaattatcctaattgatgatatagaacaaggcccaattaatttgacaaacagtgaaaaacagtcattaacataatcaaaagtggaaattagccaagttacacacacacacacagcagtagcagtcactgagttcaaagaactgaattccccaacaggaggaaaattgcagcttttttctgaaaagtctgtttatgctcaattgcatttatttacttgccttaaggacattaaaaaattgataggaattccaaatgactaatcaaagttggttattctcttcaaaaataaataaaccagaaattgaaaaagaagcaaaatcataaattatcaggctctgttttaattacagcatgttaaaatatattggtagagggacttgtcttaacattattttttatatttttaagattctttaaaaattttaccactctcaaagtacataggcattgtcttaacattaaaggcagacattactgagaataaaagtggaataattaggtattaatttagaatagagattacattaaaccttattagcattatctgtatcctaaaaatcttaaggcagcaataatttggaggactgcatgatgtattttctaaatcagattatttatacaatattgaaccatataacatgcaacacacatgtagtgtagtgtaatagaaaggatactaagatgaactaaaattggaaaatttagtttaaattctgacctccaacaacagtatatccttcaaggaagtcttttttttttttttttttttttttttttagacagtgtttcgctcttgttgcccaggctggagtgcaatggcgcaatcttggctcaccacaacctccaccttcagggttcaagcaattatcctgcctcagcctcccgaatagctgggattacaggcatgtgccaccacacccggctaattctgtatttttagtagagatggggtttttccatgttggtcaggctggtctcaaactcctgacctcaggtgatccacccgcctcggcctcccaaagtgctgggattacaggcgtgagccaccgcacatggccaaggaagtcttttatatttagcttctctgagcctcactttcaacatctgtaaaatagggataataattctttctatttattgtaggctagtgagaggcagggtggtggaatgtaacatttcccaaaaagcctatatgttgtatcctgtaatttgcaggaagttaacaggtatgcaaaaaggaaaagattctgtgagcaactgagtttgcaaaactggatgaaaccttgttaatttctctgttgcagaacttttcagtatctttaatcagataatattctggtaagttttgaatattttctaaaacacatgatcttgaaaatcccttttcttaaagcattttgtaagactagtgttaacatggaaaacactttgagaaacatcactataattaagaaaccatrgactccagagtcagaaaaacctaggtttcaatcccagcaatgccatttaccatttaccagctatatgaccttgaacaaatgactaggtrtatctgcgtctgtttcctagcatgtacaggggaatattaatattaaactgacagagatgttcagtggattaaatgaggtggtagtattagtaacagctaatatttatcaatcacttactatatgtcaagcactcttctgaatgttttacagagataacataatttaatcctcccaacaatcctgaggtaaatactactttggcttcattttacagatgaagaacttagagattagacacataaaatttttagtacagtgcttgcacaatataaactcaataagtattatgtcttctagttatctaagcttaattcactagttttttgttatgatcaaaatagtacaagtatatcattttttaaaagtataaactactaagcacatgtcacattgtctggtgtgcttatataggggtagtatgtaatatttacatacatgtgttaattagtatgacaactatttttagaagttttaccatcccgggctcaaaaagccaaagatttttgatgactagaatatataactagagttttcctgtaggggttccattctgttcacacatattcattgtggttaaacatagaactatactatggtgtgtttttatttttaaaaagaggaaaacctttccccttggatttaaggttaaaggattttccatcaaataatactgctttagttcaattaggcacttctgaaataggtttgtttgcaaagctaattaaagaaagagaataaatttggggacccatagcttttatgtattactcatataggaaagaatttgaacttaatttataattgtatttatataatttttacttacaaatcgccaaattatacttggcttaggttaatatagtaaaattagtttgtatattctgagtatacattgtttgagtgagagagaggggcgttcaaggagaaaattaaaataaaatggggaggggtctttttgagaaagtcttaatcattttttcatttgttcaaattaaaaaaaaaatcacttcttgagaaaactcaaaycaatagaaactctgtgaatggtagagatttttaagtattccttcccctaaacattgatatccatgattatgcctttttttatagacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattgtaagtcaaatagaaaataaagaccctcaactcctataaaacttcttaagaatattaacagtaattaaaagtttcttagatctgaatgaaggctatcaactagagacttctgagtattcatattcaaattggggtattttctatccactaattattaactgtataataaattatttcagttagtgcctttttcgtaatttcagtaagtagtataaactatatggaaatttaaagattgtgttcacctatcatgttatatagcataggacagaatttcagaggggagaaatctagcttatgcttcagtaatcaattttacaagatttgttttgacttcaaaaattctcatgatatttaatacacctacattgaagagatacaattcttctgctgttaaagatttatgttgaaaacaaaagctagacttctcttgtgtccaagaatgttatctatttaattgcacttgtctacctatgatctagtggaatagttcataatctttatggaaaatgtacccattcagaatctgataaaagtgatgaggcccctttttactcatacataaaattttataaccctcacccctcctttttttttttttttttttgttcattgaccccatgaatccaatccataaatttccagggttaagaattccctgtaccacaggttaaaaatccctgaaaaggggattaactcttyaattcaaagctagatagcaaatgtgtaagtgtctcaaaagcaaaattctgagtttgcaatctagaaacataaaaatactttaccaagtatgtgtttattttttaactaaaagtgttccttggaaatatttaaatgtcttggtaacctattttatccctgtttggttaatagagtaagttcaaaggttctattggtagcagtgacatcagagaaactgttatgatcatcactgggacacttgtcagaaagttgtgtcagaatgaaggctgcaaactcwaagtaagtgcaaatccaatctcatgtattacatcattctacaccattgtccatttgatactcaccatgctgcctactattggcactcctaattctctttactctattctacttaccttatttgcatagcaatttttgccatctaacatatattaaaattcagtcatttattatgtttattgtatatttctatttcactagaatgtaagttccatgaagaaatggatctcagtttttttcaacaccaattgctcaccagttcccggtacatagataatatttaataaagacttgctaaaaagtgaatagtacaataacctccctacccatatactttattgagtgcccactatgtactcagttttaaatggtgtgtatgatatacttcttgttttcagagaaatattagactctaagtctatctcctagagtagaactttgtatatagtaagtgtggtttccagttttaagttttgatagtagaaatttagttacttttaatcacagagaactttatattttattttcaatttcatttgcctaaagcttttccacttgcctgagtggactatcaattttcacgtctttcttattaaaaagcaaaaagcaaaaacactttttaagtataactaaatatggaaaaccaaaatagattaatgtctaacacagtccatctttctataatgcaaataaagatgctaaatatataacaacatagtctttttttctgtccacattatacagccagtgtcccatcagcattttttctacctcagacagcactatatatcattttgcttactaagtgcttgctattaaaaatagtagggaaaatgttcttgaaaccaaatggtcccaaaagaggcaagccaaaactagaatatacattaagtatgaaaaagatcactaaaaacagtagtactgaaaaggcttgggtattaacttattaagttctggcagaaattaaatttattatttttatattagggaagcatgacttcttatatttttcaatttccataattatttkagtagctgatttacttcagctatttgtgtattaaatatcttggcaaaagataaaacccacatatcaaaagatctattcagcagtatttaatgagcatctactctgtactaggcatgatgctagtcctcaaataaaaagataaataaaatattctaccatcctcaaagaactcctagtctgtttatcaaatataaacaaataaataatattgaaatataaacaaagtgctcagacaatacagaagatgcagcaacgttttctgtttgagtgtgctcgagaagtttccaccaaaataacaatttttgcacttaatctagaagaggtttttaagtgaagaggtcaaagtatggaatgaaagacattctaggagacatacaataatgtatgaaaaggcccaaagtcaaaataggcctggtatggttgggaacagtgagaaattctgtggggttggaacataaaatatgtatgtttctgggggcagataagtgacagtggagacacaggaaagatgggaaaagagatggaaggtgagccagatcttcattaataacaagctaaggagtctggccttcattccacagaaagaagagaacagtgaagtctttaggcggatgaatgacatactcagattttttattaagaaagaagcaagatgttttgtggactgattgtttaactggattagagttagtgagatctgactggaagcatttgcaataacctaggcaagaattagtaaaggtctgaattaatgtaggggcagagggctgagaggagatagattcaagggccactttatttagtgactgataagatgtggaaaatgagaaagagataagaatccaggtgactctaaagctttcagttgaggttaccaggtgtatggtgatgccgaccacttaagtaaggtttatacagcctggttgggggtgggaggagagtagagctattagtttgttttggccatgttaagttcaaaatcctttgggtcaccaggctcagttgtccaacaggcaggtgtccacattcacctgcagctcaggagagaagttagggtcagaaatagagagtggctgaaaccttcaaagagactggggttacctaggaaagtcatgtagcataaggaaacagaacaaaggatcaaatttaaagttcttctgataatggacagcctggttctcatcacatctttaaaattaccttgaaggtagctgcaaaccatctactatcactggcattcaattttgttaatatttttgagcaaacattttttttcatctttgaggataataagatttggccatagtgaatttactacagaagaactgtagtaaaggttcagtttttcttttgaattttctgctgtgaaacactcatctacgttttgtccaaatcaaagatatatgaaagaaaggaaagaaaattatgtattgtattaaataagcacaaatttaaggtagctactgggcacactatatgcatgctgtgtaaaaggaacctgccattctgtgtagttctatagcctttcagaacttactaggataaaagctacagtcctgtgacagtctgaatggcagctagacaagtgcacaaccagtactatgccacatgtttctkttttatgtttgtcttttgcttatgttttgacctcccggcatcctaattccttattttcactgaatttgtacttgaaaaaatgtaaacctacagaaaagttgtaagaatagtacaattccatgaacacccagatatctttcatctagattcatcagttgttaacgtattttcatctttgctttatctctttctgtcttattttagttgaataatttgataataaattgcagacatctgacattttacctctaaatacttttacttcttattacttgagtgccattgcaactagtctcttacaatgaaaaaaatacatgtatttaccaaattgtgagttcccactgctatctctaattctaattctaattcaacactacagggttattttttccctcatttcatcattctattttccttcycccactgtgacaactgtggttttcgagaacaccaatatattgattcacctgctcaattctaaaacatacacaatatatttttggaattgccatactgatattactacagaaacaaactaaataaagttcaagacttttacagttctttttgtccttagaatatattccatcgcatgtacacaaagttctatgctcaaaagttacttggattaattctttttcattctcttctgtttagtcatattatcaagttgatagacatttagtttcatttgtttctggttaaactgaattttgataattttccatcctgttgatttaattttatttcttgaacatgtgaaatagtaatgtggttcaaaaggcagaactgtgttttaaaagtattaacagagaggtctcatcgcttctcgatgcttttcccccaatctcacctacttcctctaggtaaaaaaaatcactcattaaaaaaaatttttctttctatgtttctttttgcaacagtaaacagatgttcacacatttacatacttttttgcacaaaatatatcattctatacatactctttttgtatcttacatttttcacttaacaatatatcatgaaaatattccctacatagagatctttttcattccttttgacaactgcctagtactccattgtgtctatggactatgttttatttaatatctcctatgaatggtcatgtaagtggcttccactattttgctgttataaataatactgaagtgaataatctcaggcacagatttttgctattgttgagatgtagcttcagggatagagttgctggtcaaaaagcagttctgtttgtttttctcacattatcttccataggaattgtaccattttaggctttcatcagcaatttatgaaaaggcctatttccccatagtctcacctacaaaatatgttagcaaacttttgaatttttcaccaatttgatagttgagaaatgtcacttctctgattaagtgtgatgtttagcatctttccttctattgggagccttttgttaatacttctccactcttccccatatcatccattctccccaaccccatgtatgtgtgtgtgtgtgtgtgtgtgtrtgtgtgtgtstgtgtgtktrtktgtgcytgtagcctaatttcagaggttatgaatcctgtggatgaattagatcttaaaaccctttatttttaaaaaatttttcagcctagactctgtcatacaaagaatctttattttaaacatgaaactgaagcctctaaaacatatgtagtggcaaatataagaccagaacccagatgtccctatttctaatttgctttcccattaaactattaacttacactcaatccccctttttctcagactaggacaaaaggacttttctgattgtagaacatatttgaaaagtacctagtaaagtacctaccacataggaggtactgaggaaatattttttgaactatattgcagcattaattaaatttggaattaagtgaaaacaaacacttttaaaacatttagagccagactttatggttgaactctaagaggtctcacccaagttcttacttaaggaaaggtgtatggtgacactaagactccatctaattgttgctttagcaattcagtgaatgagcagttttttgaataaccaatcacaatgaaattaaaaagtggccttatatattcaaaatgtgttcaaaacaaaatatgcccattattgataatactcattgcttcttaagaatgtatatgtattttttttaaaaaaagcataacacctttatcaagctttacttgtttgcttttattccactgtgtgcctcagtcaagcaaccaatgcaaaactttgtaaaactgtaggttgctttcttggacccaagaataaagccagtctcacccaagtcttcttcaatgtatggtcatgcatatatctaaggtatatgatttttcaggcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtaaaatctccaagaatatttgcaacatttacagaagaaaaaaaaaaagcatgctgaacatgagtcaaatgcaaattccgctcaagtcactctgtattttccccaaatagtcttctctcctgcttaaaaataactcttaaattgcatttgcggctattctaaatatcctcacagggtaacgtcctatatctatatcctgaagcataaatattgaagcatattctcttattttaagaaacaaattcttttttgaaatatatttacttttataagttttaagatgctgttacatttttcaatactgaaatatcctggtttaagtataactttgtttgttactacaactacatttttcaggaagccatctaaattaaacctttgttagggcagagaatgtctataaatctcaagataaaccatctgccgagaatggtgtttccagtttatagctaagcaccttcccaccagttttgtgttgaagttggtggctgcaaatcatgatggttaggggcacaggcttttgagaaagacagacctacgtataaactctggctctgtccttccctggttgtttgttcttgggtgacttgtttaacatctacatatctgagagcaaagccaagatttgagggagttagtaaaaggtaaagggaaatgaaattaaagaaatatttataaatgcttagtatagatccttacacattgaatatcattaggcagttctaataatcaatgaagttacttgttgctatggaatgcaattattttggcacgttttcttcgatgctaatgttttgtttagaaaacaaaaggatcctaatgtaacctacagactttgggtaataatgaagtgccaggtagatttattgaatgtaagagatgtaccactgagggcattgttgatacaaggggtgattgtgcgtgtgtagggttaaaaggtgtgtgggaactctctgtactttccactyaattttgctgtgaacctaaactgctctttaaaaagtctattaattaaaaaaaagagagatgggaagattctgaggtacttcattgtaaggaaacattacttcatataactacctttccccagagccccatgccatgtagtatccttaaaattctatattagttaggtaacaccaggttatgctgcaataamaaatgtccctcaaaatctcagcaatgtgttaaaagtttatttctgagccaggcatggtggctcacgcctgtaatcccaacactttggaaggccgaggcgggtggatcacgaggtcaggaattcgagaccagactggccaacatagtgaaaccccatctctactaaaaatacaaaaatcagctgggcatggtggcacacgcctctagtcacagctacttgggaggctgaggcaggagaatcacttgaacctgggaagcggaggttgcagtgagccgagatcgtgccactgcactccagcctgggcaacaaagcgagactctgcctcaaaaaaaaaatgtttatttctcaggctatgcctaatgtgcataaggaagtatgtggtctgaagttcactacagtcatggaagaaagagatggagaaagccaccagctcttaayggcctcagcctagaagtgatcctcatagattctatccatggcgtattagccagaactagtcacgtggcccccaccaaatcacaaaggaatctgggaaatgtagtaacacatgtatatttttatgaacactcactattcctgctattcctgctgaaatgtccattttaaaaatctagatgtgcactaagtttgaacatcttatgaacaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaakgtataatayattgcacatgtctctctgtgtattcaagcttatttgtgtgttcatggggtaccgatgtagctaataataatgatgtggtcattatgcagggttacgttgcataaaaccaaagagtgccagatttcccataatagggctatttagggggccagatgaaacaacttcactttggcactatgagtccatgactggtaactctgggtataatttttagtagggatgtcttgttcagtctggcaagtgtatattgccaaatgttttaaaagctaactgcattttcaacaggattttaaaaataagtacaacaaaacaaagtaaattcttaccaaatggttttcattgtaacatttcaagtgttaggaatttttgaagcctcatttatcacagatcaaataaatttcccatttaagtttaaaatcttaggcacggcccacatttcaaggtgattcaaaatttaaagagtgcaatcagtagagttcatcactctataactcttgctgaattaatttccttccagttaccaagtctgtcctcccaaatgcaaagtggctcccccaaggtgcctcctccctggaattagagggtcagagaaggaagtttcatttttcctgagttacatgcagaacactacccccacgaaagatcagatttaagcattcaccacagagattggaagggtggaaaataaagggaaagaaaatgaaaaaagacagcattaaaaggttgaaagaaagagaaacaaggactaagactgaaggaagacataagaaacgggtgtgagtagaacagagataagagcaggacattcaggaaagagcaatggagcaagtgagtgagaaaagaagccaaatctctctgcagccatgtatttctagttgaacgcatttagcttctccatttctttgtttgcttttatgagrccctgtgaaggagatcctgggtgtacttgctgccttcgtcttatggctctagcatttcagggacccggaaagaggagacagtggggtagagaacagactagaaattgtgaggaaaatatcaccaacattatggttcagagtctcagaaccaaaaacattagagtggggaggaacactaaaggctcccttgcttggtatctctccactgtagggctgtagtctcccagcaggtggtattcagactttgcttccctctcccgatgacaggaagctcaccatctttgagggaacttgtgccagtgttgttcagagactctcaccattatgtctttgtataatctgaaatcttcctattggctctggttttatcccaggagcaaagcaaaacacgtctagtcattcatccacaagaagaccctttgaatatctgaggatagctgtcataacccttctcatctttgcttctctaggctaaaatcttataacctagtgatattggaggggaaacctctcaggatgccattgcctcccctcaattattttctaccttagacctaggaccagatttctataattgattattttgatgttttgctatgttgtcataatgttgctattactgatatgattaatgttatgtaatcagaaatgaacatcttaacactaattacttagacaagatggacgcaatggggtaaggattaagacttactccagaggagacgatgatttctatatgggttttactgagctgtttctgtaattggaaacttcacagatatagaagaaatactggaaatgtactgttatatgtcattagtgagagagactattagggaatgcagaaaaacatttaaagaaatattgtgcaatctccccagtttggcacaattttcctttaagtgtatgcactattaaacaataaaaccatgamgaatcaaagaattttgccatgcctgaaatgtgtctactagtcaacttaagccacctcaaagctggacacccttgccttgctgtcattttgataccaaactaaatttcaaatatctgagtaatgaaggggctagccctaatcctgatgctaccacgccagctggcaccaccctggctcttggaaaggcatgaggaaaatttggcttcctcttttttccactgaggattttttttttccaaatttgacttgggaaacwgtcattacaatgaatgtgcagctttttttttcctcatatgttgcagcaaaattgtccgtcgagttctgaaggaaatggtcgctcacaattatgaccgtttctccaggagtggatcttcttctgcctacactggctacatagaacgtatgtacaccaaaaagaggttctccttccataccycacaacttagcattgctggaactgctattaaattacagttattgtgtgtcatcaggtagtccccgttcggcatctacttacagcctagacattctctactcgggttctggcattctaaggagaagtaacctgaacatctttcagtacattgggaaggctggtcttcacggtagccaggtaactcacttctcatggattttgctyaataaagtatgcaagaaatcaggctgaggtaaaataaaacatatatgctgtgggtaatgctatagaatgtataagttaatggtggcttctgtcatattttgcccatgatttccttatctgtaagaggctgtatggtttatagtcactcagagaaagtttcgaatwtgaacttgaaacctaagtaatttgatccattgaacttgacaaatgtccatttgtcttttcaaaggtgcacatattcacaaaactgaaattgtgccaatatttcttacataaacgtttaaaaataatattttatttttattcacagatatatttcttagcctcctctcacccccaagtatttaattmtagaatatattttccttttctggttgtttctatgaagagattgattccccataataaaacccttcataatagaatatgatgctctaaagagtcaatctgtatttctccaacactgctagaagagaaaagaataaaatgtaggcattcaacagctggctgacttccatccctttagtgttatccaaattgaggtgatggtctataaagacttcctaataatgacatgtactttctttttagtttttatgtacatgaaattattaccttgtaaatacagccatttaagtttttaaaatgatccaatgctataaaaacttgagtctttatcaatcttatattactataccttttggtagtactgtagtcagagtactatgcctttctgtcctgaggaatcacaatctgttttctgatatgtactttgaaatgcaaaacatccaggggttaaagggctgggtatggaggacagaaaatatgtaggattcctatttgttgtggaaataagtgtgttagccccctcatggtgtttatcgacttttttttttttttttggctagggagaaaagtttgacatggaatggggtgagtcatggcttagagaataccatgtcctcacatagcagcagccttagaatgactctgccaacacctttccatctacttttagatgctctgcaagacagctgatgcgttgtatatgacagtcctggaaagactaagagtctgtaggatgccatcataaaatagaaagctcatggttttcatagtcagacagaaggggtatgggtcccgcctctgacatttattagctgagtaaacttgaaaactttttttgcctcatctacaaaatgggtaatatcatatgtacttcaaagagtggttgtgaggattcaatgaaaaactaacccaccttatattcaggcacagaggtttttgtctgttttagtttttgtttttagctgttgcaaatatttaagtttttggccccttgagaagttctagctgcagctcagaagcttcaccattatttacagagcaggcagggagcttgcrtcatgaacattatattgattttatccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggtaattcattcagtctgtgagtatttattgagtccctaaaatacgccaggcacgttttaaatatgcttagttcttggaggatacaagacaaaattgtgcccatcttggagctcatattccaagcacttggccctcttggtattggtcccctttctcctttactatagatatgttataatttcatwtattagatgattaataagtgcctttaattggaggcaaagagaaaatgttgatgttaacagaaacaagaaagkttaggacacaacagaatagagctaccactgtctcctcacttggctctctcaggcacgagggcttaggtgatatttatcctgaaggcaggagctgaactatgtggccttataagtcactgatgacatttgtaatgacagagatgatgaagatgcatacagtgcatcattttgaccctgccaaattagtagaggcacaagcaaccacggccatgagccacatgcaagaaatcatgaagactctttgcccaaaattctcatgtatataaaatctcagaaagatgtgttcattcttagagtataggagtactttcattctctagagccacattcttcaaaatggttttcaattttttgtggcccgaaatcttatgatactgtaccaaaaaatgacaatactatctttgatgcagtaagatttaagtggccaagatactgtgggatggagatggtctgcctaattagattttctgaaaaacagaagagggttaatctgaataacctttgagtctgaatgtttggtgcttaaaatttttctttaatagtttgatttattttctgcttcactaagcatagcaacataaaaaatgatatatttgctaaataaaatcttatgaggaatcaaagtgatcactgtgtactctaattcatacttattatattgagaatatataaggagattgaaataaaaatttacagatgattggattgacttgtaaagtttactttattgttttaatacattaatggataatagcctacgtktgaattttgcctccgttaccttcttgctatgtgctcttgggcagttacttaatagccttaagccacaatttcatactagtaaaatgaggcacctggaacaggtggtctgaagattttatcagcttttttgtttgccagataatttgaggattctgatttgttaggttctggttatgaaatcatagattttaagggctgggagatatcttaggtattagactgtattaaaactcctccaaaagctcattatttgggattaaacagtgttaattttctatctttcttgttcctcatatcagctcaggatagctgtatataacaaaaacaaaaagcaatttagagtggcttaactaaatagtttcacttttatagtgtaacaaacatttggaagtasgtggtccagggttaatatggaaatcttaagatatcatcagaatccaagctgccttccttcagctcagccattcttacttgtgacttttgacctcatgcttgtcaccttgtgattatcagatggctgctccacttccagcaccacttcctcattccaagatggaagaagggaaggataagaggtcacagagtctgactctttttcaagaattgtttggaatccctgtctaggttttggaccaaaacggtgttacatggctatctctagctgagagagaagcttttgaacatagtttttcaatgggtgtctgaacaaaattgtttctgtcaatacaaatgtagaaaggacaaagagcagtgcgtcttgtatcccttaatcctcaagtcacacatkaaaaaaacagttctcaaattatatcagaattttacattgcacaattccagttttaatgaaagaatcgtctaaaggcagcataagtactgaaaaagtagtccacgttttaggacacagaggacagctcaacaccacctgtatgtgcttagctacccataaacaatgcctgaggatttgaatcggggtgtaaaaccatgaggagtaatctagatctgggtcagcaaacttgttctgtaaagggtagaaagtaaatattttaygctttgcaggccacatggtttctgttgcagccactcaattctgttactgtagagtgaagacagccatcagcaatacattaacaaatgagtatggctgtgttccaataaaattttatgtacaagaatagccagtgggccagacttgcctgctggccatagtttgccaatccctgatctagattawcttgtacagtttttctattcactaagctagggcagctaaggcaaggcatattctatgagaaagattgccccctagctattaaacatagcccagtgtctgtgtgtcaggttggagtatttggcagatctgaggttattatacaaattaagctgtctgaggccccctggctctgcagagcactccagtaatgccatcctagcttcagagacacataccactctaggtcaagtgctgacactgaaggaaatgttggcagtgggtagcccatcacagccaccagggcagatggaattactctgtgcttgctcacactttctctcttcagctaattggattactcttcagagaaagatgtctcataaagtcagtttaataaggggatcctctttagccagtaaagaacatatttccctaaatggaagcaacaggatgagttgtcaaaatgtcagcatctgagctataagaaacacttatgggaccaagaggatcaaagaggtcacattagctacaaagttctaatawctttttcctctagttcataggaaagaatctaaataaatatgcactctgggccaaacaaggacataaacctatgctctctctctctttttttttccttttttgcaatatttcttagaacaggctttcttgtacaccaggagacaaaagagaggtatgagtttgtgatagccatgaatattagtagaaaagtcttcacccaggccaggtgcagtggctcacgcctgtaatcccagcactttgggtggccaaggcaggtggatcccttgagctcagaagtttgagaccaggctgggcaacatggtgaaaccccagatctacaaaaaataaaaaaattagctgggcatagtggggtatgcctgtagtcccagctactcaggaggctgaggtgggggtgagaggattgcttgagcccagcaggttgaggctggtgtgacccatgatcacaccactgcactccagcccgggtgacagagcaagaccccatctcaaagaaagaaagaaaagaaatgtcttcaccctagagacaattggagtgtttattctggcttcatgtgtagcctctgagcctgatttttcctttcaatcttaagatataatgcctaccatggaatattggtatgaggattaaatgagacaccaaagctttgtagagctttgggcacacagtatgtgctcaaaacctgttagttctacttactttatactgcttaaaaattagcaccatgtggcttagtccctttcaaaaaggaaagagtgctttgtttttctacaggagtcagtggtttatctttataagggggtccaagaaaattcctctttgcacatgcattcttcttttgtccctttgtgtaaggaagtagaattttcccagaaatccaaggcactcctcataacccaccttgcaatggaaatgctctctccccacaaaaggtgcgttgtctaacagccatgaaatggccttttccatggcacttggtgtattttgccttccatttaatatatggttggtgggaaggccaagatccacatcacaggcctctgctggactgggtggatgaacaagattataattttcaaattaggaagagagaaaaagatgcaaagaaaggaatayttctgaggtgaggcacaccatagctttcatttggaaayaatcatgtttggagtacacatacagaactctcatattttggtcccatagttcacaggcataggtgaaaatgtgggcatgactattgtgttttcttcaggatagtttgtgtccatcacattagttataatgcctcaaacaaccccttcatcccatgcagccatattttgtcctatatcaaatgtctctttaagtatccttagrgctatctcctaatgtgtcctgarcatggcactgagaatctcatgcttccatcaaagagtgtccttcagactgaaagtagcttcatgccgcaaccgtacttttttaatacacctggttgtaaaccaagtcctttgcctggggtttcctgtgacctttttttggaaagtgaagagaactcagggagatcaacacaatccttgctagaaagttaaatcatggcagttatagctggcaaatgcatggcttgtttggtctgagtagggcagttacataaagaagttagtcatcctgccggttgccaggaatttaagatctttggaggaatatcaaaattaaggatactgagtctctttctcaaaatcattatcacttccaacactgtccccaggcaatctgattccaatccaactaaaaagttttgtgccaacatcacctcaactaatgtacatgaaaaaaaaatgcaagacttaaaggctaaatgcaggcaaacagcacaaaacaatgggtttcagacaaccacaaaatttgctcaggatgggccatgtttgtaaataattactgtccctatgaaaaatactattgagttcatgttgaacttgactattaactcagtgtcatttcaaatgtcaaacagcagggtattaggcttagttaaabttgccttcgttttctagttggatgtaggcaattcctggaacttgtatacagttggygtctctgtaaccgctggttcctcatcaaattcaaccaacctcagatcaaaaatatttggaaaaaaaacaccaaacaataaaatatagcaaaacgacagtatatattcatacaatttttaaaatacagcataacagcaacatagcatttacactgtattagrtattataagtaatctagagatgatttaaagtgtatgggaggatgggtgtaggttacatgcaaatactatgcctttttatataagggacttgagcacccttggattttgttatactcagggctgggcataggtagtcctataacaagttccccttggatactaacggacaaacacactccactgggagttttaaatcttgtctgttattttctagcaggatgcagttgactgtatttgccacagcacataactagagaagtgctgaaggacctcgagagatcacctgatccaaacctcctccccttacttccctggacaaaaagccacagctagatttctgatggagatgccttcattttccttagttcaaaagtttccaaatttaggtggatcagaatcatacaagggcttgttaaaacatagattgctagaccccatcctcagagtttctaatttagtaggtatgaaggggaacttataatctgtacttcaaaccagttcccaggcaatgctgatgctgttgttcacagaaacacactttgagaaccattgttcctttcaaagtgtagcaatgattgaaggaaaacatccttcttaaytggcacttcatcactctggtattttaattgactaattaatttagcaaatcaacagagtctacttccggtgcttaaaattaggacagcatgtttccaagcctagagaaagactccaacatcaacacaactcaaatggaattatctacagcaggaggtcaaatgtgccattggaaagggggttaactaaattgtacttattatttttataactattattatgcttttttcttctaggaacttcagttacaatctggactaaaagccaatatagaggtccagggtggtctagctattgatatttcaggtgcaatggagtttagcttgtggtatcgtgagtctaaaacccgagtgaaawataggtaagtgtttatgcattatacatttatgaattacatataagactatatacagagaacttccgaaatatgttttgggaattaatcttctgacttttcaaaatctatgctttctatttggaattataaaacgatagagttggaagtgatcataggaaattattctgtctatagcttcttatgagcaggtcagtacctaatatgactcagccaagaattttcctgcttttaaagacatacatagacaggatgccctgtgaatcagatggttcatcttcttttggtattccaccaagagaagaaatttcactttaaggtaaactttcctcttttgttgtcttcagtggggaaaaataaaatagataatttcatctgtgcagaaactaactattaaatgttaagagtccttaagtcttttcatcagcattcctttttctaaataaaatactctaagctcctttaatttttctaatctacctgtgagatttaatgaaagtgttttactttgaatataaaacaatgtctttgaactagtgtgaagatgaaaattattagccttctgttacagaatttttaaaaaggaaatagaaatgcaactaattttaattttttgatatttaaaaacacattcaggcaaaagtgagatatgtgataaaatcaaatttttgattcatcttgagctatggatgaaggaactgagagcaatcaaacagtagcacatttaatgtgaagtgtgacccacagtgttaccaaaaggaamcacagaatgaaaaatgacactggtcatcaaaaggttcacaatataacttagggcttcccacataatcagtcatctttcacctctttccaaagtactttctagacagaagtttttccaaatgaaatggaattgaattctttgcaaagagaaatcaacaacagcaacaacaacaaaaagtaatttggattttttwaaaaagtacacagtatccttaagaatctacccttatccatattgtaaccaatctgtcttccatttccacttgttcatttgaaaaaaatatcttttaaacctttgctgaatataggacatcagaaggtactctaagtgattcagggattaaaacgacctctgacctatttttacactgatcataacagcagcaggggttttaatttrcrcagcaaaaattaatattcctgtcaaaacataagggcataaaactctcatttaattgtgaaagcagtttctcacagtttgatttaaagtccacaattcaattacagtagaagtaagtcttctgttgaaattatttatcctcttcatcattatccagggcacattccccagccaatgcaatctgtttatccagttatctagagcatcattaaaggacccaccatwtttttcctcctaggacctactgtacatgccccactgtaagaatgattttttgtaacacaatattttttcaaatatcttggcaatcaagggcttacgcctctagagactctttggagaaggtaatgaaatggaattaaaatagctgcctagaagccaacagagagatagttaacaaaaaactataagcatcgattgtcttcttggtgagtttagactccattttaatataacttgggtatttctgacctgctgagaggactgggttccaagaatgttttcattttggtctttgttatgcccatacaaaacaatgtagtatcttacagacactccccacatctgcaactgaaggcaggggagagctcaggggaagggcaaaccttccctgcccaatatctgagactcaccaggccctggttaccagcagaactctaagcacatccaggtcacctctgaatcccttaagtgtttccttccagtcactggcatcatacgttcagaccctgtaaagttacagctgttagtccaatwccattaaatataatatgaacaagttttttctttttttctcaaatgtttagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggtaagatgcagcgttcaggtcatgttccaggaccatccccagtgcaccaggaacttgcattcagtttagaacattcagtttcagaattaaaacraaacagtagaaacccagggaaagatgaattttctttaaatgagtagaagaataattgataaggccaaaaaaagtcagtttctgggataccaaaaaraaatctaatgactagttcatttgattctggagatagttatcatattctaatccagaaacaatttatccaggaaagaaaggcctatgatttaccataggagttgccacatagtttcataaaaaaaatcagatacacatttactgtctggtatcttcacaataaactgctggacaaaagatttcaaataaaacacctggcaatccatttaccatgtttaagggccaaaatgaattcgcaatttttaagtattccatatagcagcaacttgaccctgtttaagttttggctcaagtttcagagtttgggattctgaatttttttaaataatgcttttggtaaaatagttagtgttttaaaatacaaagatataatttccatgtaacatttgtgctgtgtcatttgaattttgtaaccattatttgtaacaatactatcacatagagctagaatgccttgagtctaggtagcactgaccctttcataatagttgacctacggtaagcataagggtcatttgtacagttaaaacagcaagccacatcttacatcatctccttttttaagtaggccaaaattgagcaccttcattattttactgacatttcatgattcatattaaaaaacgcattgattatataaaagtaaacgagtcagttgtattttcagagaataaaagattgtgctttatagttaaactattaagctgtcactaacttacattaagtkatatctagaatgaacctccacaaatgcattttaaaaaccccaaccttctaatggttgaaatgcagtgaccaccaacccacccacatgattaattggtttggttccacatttgccttgggcsagagctcttagaatgtttctctgtccgcattctctgcttaaatccagctgggcttgcctgttactcaaaaggagagtgctcccaaggtggggcttctggaatgaagggtgagacacagcacagcctgcaaagcttaatggcatcaccaaaaagctgaaatgaatttagtctttcattctagaaaaatgtatggcaggactcccatatcccaggcatttgaagtgtttctgttgatataaaaagaaatgagaagaaaatcacccattcatggagtagcctttgacactcatatcctttctcagattgctttggaacagaarcttcaagtacattcagtaacttggctggagaggtatagggtgacttaactgtgtgtgtaattctgttattgttgctgttgttgtacaggcaatttgagwaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagrcttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtamtctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtscttattttccactaaacacagacacatgaaatgaaagtttagctagcccactatttgttgtaaattgaaaacgaagtgtgataaaataaatatgtagaaatcatattgaattccttttgtcttttgttacttccaacaccatatttctcattcctgccactttctgagcctagacacatacacagttaagcctctgcagcaatacaggtcaggccaggttctctagatgggagaccagacccatttgaaaaatgggccactgaaaatatcagcagtcagaacctcttaaggacgtgtgagcttgaaaacatgccataaccccagttttcataaagctctggactggcccctttactgtcatgttactaaaaaggaagaaaggaatcagaaactaaggtggtgggtggagcatggtatgtggtagcatcagccttggggaaaccactctgtaaagatgctgacgtcgcagggaaagtgagttggtctagggtactaagctgaagatgttgtggactcaggcgcttcagccctgtgaggtttaacaaatcacagccacctctgcaaaatgtaatcatttacttaacaatgatgactgtggtgctctgaatgttagtgttttgccatttcccaactgtttactgggctgctgagccaagtatctgcccacccagtggagaatggatgatcctgagcaactctaacatgctccaaagaaacaagaaagcagcagcataggacaaacagtaactcctttgtagataaacaagayagaaaatgaagaggggtagagtgatagtccacatttggaaataagatattggagccagaaaaataactttaaacctcatttgcagtcctctagttctgactacttctccattataaatgccagcatacagacacatttgtcttctgaaaagacatctatttgggaattgtatagccccctaatgtgaatctccaggcctctgtccagtcagatctttcctgcaagctttaagattagcgtggcttcttttcttctgtgaagtgttattgtcattccctggctcatgttgcagtcctgcctgtgacaagttgctccctgcttctctaaactgaccaccttcaagtaagtgttaaagctaacacttactgagtgcctattatatgcgaggtattttaaagccttttccgtacattaatttaatcttcataaaaactatatttaataggtagcattatttccatatgatagatcagcactaagagaaatataatatgagtcacataagcaatttggaatttctagtagccacattaaaaatgtaaaccaaaacaggcgaagtaaactgtaataatatattttatttaacccaaaatatccaaagtattatcgtatcaatatataagtaacataaaaattattaatgggaagctttacttttgtggggaagattaggtcttcaaaatgtggtatatatcttgtatataaagcacatttcagtttggatgagacacatttcaagtgttcagtagatgcatgtggctagaagctgctgtattgaatagtacaatattgggcacacaagacatttaatttgccccacagaagacactttctcacttagaaagtgaaagaaccaggactcaaatatgagtagtttcacctcagaacctgctctctgaacccattataggatgtttcccacatgcttttggttttaaagatttgctgccaaacgaatacagacagtaggttatgaaaatgagaaacatgtgacagcagcaataaagctaagagttgttgccctttctttttttttgagacagagtcttgctcggtcgcccaggctgcagtgcagcggcgcaatctcagctcactgcaacctcttcctcccaggttcatgccattctcccgcctcagcctcccgagtagcagggactgcaggcgcccgccatcatgcctggctaattttttgtgtttttagtagagacagggtctcaccgtgttagccaggatggtcttgatctcctgacctcgtgatctgcctgccttggcctcccaaagtgctgggattactggtgtaagccactgcgcccggcggacttgttgccctttctctgtggtcgttcagtctcctcctctgatggaatcagaagcccaccataatcaattgtagaacgcatccatcattccaaaaagaaacctgtacactttagctatcacttccaatgtacccatctcccagccctaggaaatcactagcctactttctgtgcctagattcattgtggacaattcatataaatgcactcatatatactatgtagtcttttgtgactggcttctttcacttagcattgtgttttcaagtttcgtacacgttgtagcatgtatgagcactttattcttttttatggtcaaataatattgcactatacagttatgccatgtgtttatccattcattagttaatggacatttggtttgtttccaccttctggatattatgaataattccgctatgaacatttgtgtacaaactttttggtgggcatgtgtttacatttctttatacttagcagtacaattggtgactcaaatggtaacactatatttaactttttgagaactgccagaattttctccaatgtaactgaaccattttacattcccaccagcagtgtataagggttctgatatttccacattctcaccaacacttattaatatacttctttttgattatagtcatcctagtgggtgtgaagttagcactatatttcgaataaataaaaaaatgtatttggctgggtatggcggcccacacctgtaatcccagcactttgggaggccaaggtgggatgattgcttgaggccaggagtttgagaccagcctgagtaacataggaagaccctcatctctacaaaaaataaataaataaaaaaattagctgggcttggtggcacatgcctgtagtcccacctactctgaggctgaggtcggggaatcgctcaagcccaggatgttgaggctgcagtgagtcgtgatggtgctaatgcactctagcctgaatgacagagcgagaccctgtctcaaaaaagaaaaaaaaagattcaagtccttgccctttttaaagttgaatatttttccttttatttttgaattgcaagaattagttatatattttcagtgtaagtcccttatcacatacataatttgcaaaaatcttctctcattctgttggtgtcttcactttcttgataacggcctttgaagtacaagagtttgtaattttgctgagatacaatttatctctactttttcttttttgtttgtttgttcttttggtgtcatatctaagaaaccattgccaaatccaaagtcacaaagatttaacactatgttttcttttaagaacttcatattttagctgttaaattagtccatcatggttaattttttatatagtgagaagtagaggatcaaaatttattcctttgtgtatggatttccagttgtcccatcattgactgttgaagaaacaactctgtccccattgaattattttggcatccacaaacatgaaggctcatttctggactgttagttttattccattaatctctatgttgatctttatgctagtaccgcactgccttgattactgttgctttgtagtaagttttgtacttgtgaagtgtgaatcgcatattttgttctttttaaagattgttttggcaattctgagtcccttaagttttcatatgaattttaggattagcctgtcaatttccacaaagccagcttggattcaaatggagattgtgttgaacctgtgcatcaaaaattaattatattgtctccaggtccatgaacacgaaacatctttccatttatacacatcttgaatttctttcaacagtgttttgtaattttcagagtataagctttgcacttttttcgttaaatttatttcaaatgttttattctttttgatgctattctgaacacatttgttttgtttcattttttcattgttcattgcaagtatataaaaatatagtttttttttgtataatatattgctcctgtaaaaacaaattatgttgcaacactgctgacctcatttattcattctatatcttttggtaatagattctttagaattttctatgtaaagaataatgtcatttttgaatagacatagttttacttctttctttcccatctgaatgtttttctttttttattttcttgactaattgccctggcaagaacctccagcacaatcttgaatagaagtggtgagagtggacatagcaaagatgataatgctggtgaaaaatgtggtggtggtgacagcagtgacagacactaataaccacgggacatgaaaggaaggcccaaattgtttggcagtagctctagttctattttcactaagtaatatacagttgttccttggtatctgtgggggattggttccaggacccctgtgggtactaaaatctgtggatgctcaatcccttatataatggcatagtatttgcatataaactacacacatgcttgagtatactttaaagcatctctagattacttataatacctaatacaatgtctaaacatcacttcattcacatggcttcaacttagtagtcaatgtggggcaaattcaagttttgctttttgaaactttatgaaatttttcttccgtatatttttgattctcagttagttgaatctatccatagatggagaactcatgcatatgaagtattgtaagttctgctgtgcttgaaaattaataaaagcttatttgaacgtttaaaacactttcaagatagtctagatgtctgactgcacagagaagagatacacaacttgaggtgcctgtaccagcactaaggatatgtttgagattcagattggttgaagcttcagtgttgtcaacttagtcaacttcctcccctagaaggaagcggggagagaaagggaataggacagggaggcctggcttagaaatccagttccactacctgctggatcttggacatgggattcaacctatctgccatttccaaaatgggtattataatctttatttcattgtgttgttttaaggattcatggagataatgcatgtaaagcatactgcccagcacatacttggtagcatttggttaatgtttttaattttggagatgtagtgagcaatatcttataactgatcagttttaataaaaaggagtttgtttgcactttatttctacctcttccttacaggtagttggagagcatagtagtaattttctctctaactctccagaattggtgcagaatggcatgaaaacctttcccatgcagcatccaggaaggtaggaggcaggggattgcagcagtgaggagatttggagtaagatactcctgcatacgtgaaatctcacctcttcttcttactactgctacataaaccttcaagcctctcagcttctacattgggaaaatgagcagcacctcataggttgttgtgaggatgaagtaaggtaataagcaagttcctggcgcataacaagcatttaataagtactcattaatactaacttttcatgtgcagtcttatacaatttctgagtaaagcaacattttatgttttgactcaatggagtgaatctattttctggacattcatccatgaacatcataagttttggaatggctaccagttttgtttatttatcatgaaaacactactttcacattataaaaaattattcctccattttgtaaaaacatgactttcatccatttctctgcatacctaaattgacctgagatttcactgatcctttctttaccatttttctttgcttttgtcctctgtaaatatgataattaccaagagtaaaagaataagtcttttcactagggggcatggaatgaatttaaaattcatccacaaaataagaaagttctagtagaaagtttttggagaaaatcttaagagaactctacatcataaataaaatggataggatttttgagaggaaagaaaataccagaagacaccactccagctcagtcattcttgtttaggacttgagcagaatgtcata

SEQ ID NO: 12388 - DNA, 123593 bp, Homo sapiens
ggtaggctttggtggcaaactggtgatcaggattaggaaatgagtgcaagggaagagaaactgtcccataacaaacttactaaaaagtttgtagagaggattaaaggtccacaaatagccaagtgtgccctaaaaaagaacaaagaagagagacaagggctacaggcactaaagctcactataaagccatgctaataaaaacaggaccacagtgacataagcacaagaagcccaatggagcagagtggggagtgcaagaggcttcatatgacaaaggtggcccacagatcagctggggaaaggacaagttatttcataggtagttttcagaaaactagccagctatagggaatgaatgaagttggctccctaccaaatcacacacacacacacacacacacacacacacacacacacacacaattggttaaagacctaaagtaaaaaataaaaatataaaattaataaacaaaactgtttgcaacttaggggcaggggaggactcaaacaaaaactttaaaagcacaaactatacagccaaaaatagattatcttgatcactttaaaaagatttctgcttaataaaggacaccataggcaaagttaacaggtaggtgacaaagcagaagaagatatttgcaatgtctaaaatccacaagggacttaaaatctgcattatacaaaggaatcctgcaaatcatcaagaaaaaaacaggaatcctgatagaaaaatgggccactatgtgcacaggtgatatttatacaagagaacaataagcatatgaagagagtctcagactcattagtaatcagagaaatgcaaatttaaatatactgagatgttaccttgtacgtgttagactgtcaaaacctacatatctggataataccaaatgctggctgggatgtggagctgtaggaactctcaagcactgctggtgagatgcagcctggaacagacatctgtagggagacttgggtgtgcttagttaaattaagtgcaacatactctgtgatgtgtcaattctgaacctgcaggaaatgtttttttaaaaaatcatcacactggctcataagcagacacatgggaggatgctcgtggatgcattcattgtggtggtgggagttggaggtcttctgggtgaccacatagcgggtggacagtggaaaggggacttgtgtcatcgtgaacaactgtgcagctattacaagcagcaggctgggtgtacccacagcaacgtggatggatcttagagaaaaataaatagaatgtgatgtataacacaaaccatatatgcaagttttaaagtgcacacaaaacaccaaacacagttttcaagaactcatacaaacaaagcaatatacaggcygggcgcagtggctcacacctgtaatcccaacattttgggaggccgaggcagaaggttcacttgagcccaggagttttaggttgcaatgagccatgatcatgccactgcactccaacctggatgacagagtgagtcccgatctctaaaagcaaaagcaaaaacaaacccaaacaaaacaatatacggttgacacatgacaaccatttcctatgggctagtgggaggggaatgcagataaaagggaatttaaaaatgaaaaaaacaatacagaagaaaaacaagtaacaaggttttctgtctgttcctggccttggcaagagaggtgtgtggctccacgaggacagggaccatataaattactcaccctcaattcccagcaccaacacccatgctgaggcacacagtagatgctcagtaaacatctggaatgattccattaatcaataaatgaactgatggagaaaggactttgcagagaggctgctctggtatttggatagcccgttgattttggagtcaaacaagagattcccatatctggttgtgccagcacttgccagcaagatattgggcaagacaccttctctcggagctttagcttccacatctataaataacctcatctcttatttacagatgtggaagctgatggatgttataccttcagaggactacttgtagtaggtgcccaacaaacatgcatctccactccttggttatatggagtagagaagaaccgcacttctaggtgttattttagctgtacctggaaggcaccgtaatgcctgcagtaatgcctggaaatttcaccattatagagtcattttttccctctcatcaggaaggatttattgctttctgaaacctcctgtgggaatgcccagatctctggagaaaagttgccttcaacagattaggcttacagaggggccagctgagaaccctttctgaccctaggaacaccagactgaagcaggagggaatgtgattgttcactgtctctcacaccccaggtcatttgcacttgctgtttcctccacctggaatgcatttccctcattctccccatggctagtcccttcttatctttcaatctctattaatctcctctgagacacccttcctgaccaccctgtgtaacactagcagcttggtctctctttttccaccccatcatgatgttccatttcctttataacaatcactgtagcctgaaactctctctttaaaaatttacttttttagttacctgtcttcctccactggtctacaagctcagaaaggggggcgggctgaattagggcaataggccagaagtttaggttttagtctaaagcaagggaaagtcttgggaaggttttaagcagatgagaaacatggtccaacatttcatggtccatgaaatgtagcagttgttttggtggccatggggagaatgaactgtaggaggccaagatgggagccaggcatgggagccagggatgaggccaagatgggagccaagttgcagggaggttgcagggagacaagacgatggtaccttggacaagggtcatgatggtggagatgataagtggacaagtaaaaaatatataataatattatgtgcaactctatggaaattatggaaatgaaccccttaattttagaaaggaagaaaagggccagagaggaacctgtgttggaacactgtatcttgttcagtttttgtcctccagggcaggggagctcactgctgtacccatccccggcacttttttttttctttttttttttttgcaacagggtctcactttgttatccaggctgaaatgcagaggtgcaatcacagcttatagtggctttgacctcctgggctcaagtgatcctcctgcctcagcctcctgagtagctgagaccacaggtaagcagcaccatgcccagctaattttttattttttggcagagatgggtctcactatgttgcccaggctggtctccaactcctgggctcaagccatcctcccgcctcagtctcccaaagtgctgagattacaggcatgagccactgtgcccggccgctgacacctatttacttatcatgcagtaaatgaatatttgaaagaataaatgagtaaacacaaggcccatctgtggcatccttagagaacccttgcctgcctctccaggtacctcctccagttttcatttctgggattatgtgatgggttttgcctcccccactggatggggagctccagggggaagactttcccttcacggagcctggcattctgcttgcacataggaagctgtcaataaccagatgtccaacttaacatgaataaatgaatgaatgaatgaatgaatgaatcaccagactatataaaccagctcactcttcaccctctcttccccatacctcgctttatttttcttcttagcggttatcaccacctgccacattgcatatgtactgatgtattcattgtccgcctccgtcccccacccccgaccccccgctaaaatctagaatggaagctcatgaaagcaagggctatttacagttccgatctgccccctcccaccctctgacccttcctcctgtttcattatttcccccagcgcttgtcaccgcctcatatatcctttcgcttttttgtttatgatctgtttccaaccagctccacgagggccggatgtttgtgtttgattcacagctgtatctcagacgcctgtcaccgtgccctgcaccgcggctcgcgcacaggaggcgttcaacacacgttgttgacgggacgaaggaaggcgggatcgcgaggccagctgtgcaggtggcctgggtggagagggatgcacggccacgcgcgtctccttggcccgatcccggagcccgcccccggcctccccggcaggctgggccgggcaggcaggagttaagccgcgctcgcttccgacccgcaggtggcgccgtcctgccttggtgcccggctccgggcgctccgaagtgcgggacagaatagcagcgagcgcggagccgaagctcagccccgacttgttgatctcgcccaggcagccgccgccgccgccgccgcgggagcaggaggaggaggaggtggaggaggtgccgcgcggccgcggtcctgcccccgcgcccccggcgcccgccggcgccccccgcctcggagagcgcgccccggccccgcggcgcctgcagcccgggcgagttgcctgcccggccggggtaggcccggctcagcccggccccgggaccgccgctgcccacgggcgggggcgcccgggcggccgggacgatgcgcggtccctggccccaggaggcggccgccctgggggtgagtgttggggcgtacggccttccgtgggggtgcatggggacacggacagggggtttgcctgccgcagctcggcctgttggtctgctcgggctccgcagctccaggctggaggggagcggggtgggaggcaggcaagggctgaggcctgaggggacgcgcaatccccattctggggctaaggcgtgagccctacatgcagggggtgctcaggggaaccccccgaaatcactagtgcgcggtaggaggatggcaccttttgaaaaggccagaaaatttagctcatttccccgcctcccacctcccccaccccttcccttccaagcccggggaaaggcgcagaacccggagttataaaaagccatcgcgggagaggaacgaggaggaggagtaggaggaggaggaggaggaggaggaagaggaggaggagggggagaaggaagaggagggggaggagaaggaggagaagggggcggggaaggagcgaggggaggacggagcaggcggatcccgaggactctgcccgcccctcctgcggtagggttgggggctcagagggagaggcgagagcgggcttttcctcctcgcggctcaccttgtcgctggagcaatctcaggagatgctccagtgtttgggaagaggggtcgctccaggacagaggggctgttgtgcacaccccgtctgttgtgacctcggacaggtgggcacctggaacccccggaattcccccaaatcttttaagatttggaaaaaagcccgctgccattcccccacccccaaaatcttgattatctcgagaaggggaaggaaaagaagagaactcgttaaaaaaaaaaaaaagaaggaaagaagaagaagaaagaaagaaaaagataaagaaagaaagttttcatgcagctccccctctctccccatggcggggccaggttcgggactcgatcgggagacccataatgaagagagtttcagcactctaaggggcggacagcgccccgggcggctgggtcgcgcctgggccgcagaagcccagggtggggcctcccgggctccaggggcatctcttggggccctctccccgccccgaggggcggcccctccctccatccatggggtgcggcggacttcagcaccggcgggagggacagcgaccatccgtcctaccccactgagccgcttaagcgcgggggaaggtcaaggccggctgggagcctggtggagaggtggggggcggggggacagcatgcccagctccccgtttgctgacccgcgtccgctttcgctttctgcctcgcagccgtcgggatggaggtgagaagacggccgtgacgcgcgcccgcggggccccctgcacccccagcagcccacagcgctccctgcccccctcccccgcagcagcgggccttgccgtcgagtgacagcggcctgggggggcagggggggcgggggcggccggatcagcgatgccggcgggcatgacgaagcatggctcccgctccaccagctcgctgccgcccgagcccatggagatcgtgcgcagcaaggcgtgctctcggcgggtccgcctcaacgtcggggggctggcgcacgaggtactctggcgtaccctggaccgcctgccccgcacgcggctgggcaagctccgcgactgcaacacgcaygactcgctgctcgaggtgtgcgatgactacagcctcgacgacaacgagtacttctttgaccgccacccgggcgccttcacctccatcytcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagacyctacgggagcgggaaggcgaggagttcgataacacgtgctgcgcagagaagaggaaaaaactctgggacctactggagaagcccaattcctctgtggctgccaaggtgagtctgggatctgggggctgctggtctggggggatctgcttgcatycccatattgaggaccactgctggaggactctggctttgttcccaacgatgaagattagtaatggggaggggctaggactgagtccccagaggtgaggaccaaccccctcagacttttcccatgtggcactggtcactccatctttttattatccaagacgttatacccctacttggttggagaggtttcacagggacccataaaaagccacagcaagaagatggacactgacgaataagagagagagcacagagagacaacagtggcttgctggggtggagtagggtttgcttccctgtgaagtcccagacctaggctggattggatcaccctgtgattttaatatctccatatttataacctcactctgccccagcaagggaaaaaagcagcttacagacatgcttacaggacattgagatactgtcagatagtttaaacataagtaagaagggaccccgaggggtgggtgtggacccacacgacacatgcagttggttgtggatgcttgcgggtgaggggtcaccccctggttacttatttatttggtgagtttatttccagaatggtttggtgcagcttgtaaagatgtttcagctcttggaacaagatgtaaatttcaaaataggagmgaaaaatgaggcaatgtgaaaaataaaggaggaggaggaggaggaggcaggaatgagtttgaacacaaagagtgggccagagagtctttggtgctgctgggtaatggcaggggctgtaggggactgaggaaggcttggggtgggagccaaggcagggcaggagggcactggttgatcagcaacttctctacgtcaggctgggattyggggttgcctgggaaagatggggcctgtcttcatgtgcccgaagtgctgggtgctgggagcaaatgacaaaacagtgtgtgcaaggctataaaagaggttctgtgaggttcacggagaacccagaaaagagagatgttgatgttgaaatccagcaagaccaacttgggaaacatggggagaatgtaactgagtgtggggcctaaaaaaaggggtcaggtaagtagatttgtggtaaaagaaagaggagaggaggaagcctaaatatccagccatatcttactagctagggctgactcctgtccagcccagcctttcattgtggggtctccggctcagttctcactgaaggcccacctgcaggtcccagtctgaagggagactccgtggggtccttcctccagatctagccacccaaggagaggcccctgagagtggatggagaaggggtggctggtaagagggtggagggagcccccacgtgtttttttcgtttccctgttggccctaacaaggatgtagaggctcctgggcctggcttcctcctctgaggctgtgggctgtctctctccataatcccgcccccaattttgtgtccaaaaagcctcctcctaagacagagtcactcacccttaatcagcttaggatcaacagacttattttgctatttccaggcatgacacaggttctcccactgcacatcccatttaggcccaaatgtgactctccctccctgtcccatccctaagacatgagaacaaggtacagggaactggacaatttgccctcccagagaagaagcaggcacagggccatgttttggtctggcagcaagacccaagcaccggggcttgcaagaggtgctgtttgggaataaagaacctctcctctcccttgggttaatccgctagcagggacagccttgtgacctctccatgatcccagtctggggctgccagctcacattcctggcagatggaccatctaggattttctgtagccagagctgaaatggggagggaggcaggctcactggccctcagaatagaaatcctggctgccaatgatcaaacacctactgtgtatggagtgtaacaacgcagctctgttattatcccacctttcgcaaacagtgaggctgaaagaggttaagtaacttgcctaaggtcacaccacaggcagtcaggagtagccagaaatccaaaccgagtgttctttctataatgatcaagtgccgcagcctcctccccagtctcccggcttccacttttgcccctgcaatccattccccacatagcagccaaagtgagcttttcaaaatgtaaattggatcacattattcatctgcttaaaatcctccagaagtttcccatcacactcaaaataaaattcagacttttcatcctggcatacaaggcccaggcagaatctggcccccatgacctctctgggctcatctcttttgatctcctctggttcacttggctccagccccactggccttgctgttccataaacaggccagagtttatctgacctcaggacccttgcacttgctgtttccgctgcctggaatgctcttccccagattcccccttggccagccccttctcccccttcctcatttgagcaggtccctgctcacatgtcccctcctcatacagaccttccttgaccgctgttctaaacagtttccctcccctcactctctgttgcatcatgcaatgcctttcctgcagaggccttaaacgccatctgaaattatatttccttctttgtgtgtctctgtttcacacccacaagaatgtgagtaccatgagttgattcactgcttgattcccagcacccatgatggtgcctggcactgaggagcatgtggaatgaataaatgaatgaatgaacgaatgaatgaatgaacgaatgaatgaatcaagcaagcaagcaagcagtcagtcactgtgtctcagggtttggggacctgtcaccccttctcactgcccacctgcaacccaggtccctgtgcctctggcctcctttgagtcatctgcaccttgcccatcccatccccacccatccccccagcttggatgccttgcttgtcaaaacaagcaaagcctgtggaaattgcttagaactcacagagtgacaggaccaaatggaggaycatttctaggtgattgtaagatacaaaagtggccatatctcatatgctgaagagcaaggatggatctggttctgtgccactccccacttccatagcttttagctaatttctccaactttccaagtcccaaccttccacctgtaaaatggagataaaaggctcaccttacagggtcttcattaaatcacatttgtcaaaattttgctcaaagcctagcacatagcaggtggggattgttgttataaatgctaaggaaaagagtcttttttctagggctgggtgggccgagttgctgcaaaccctttccttctgagagcagcagggccagggagactgagctgacactgttaataattgatgggatgttctggcaactcggagacaaaccaaagcacaggccctaggctttgccatcaggggagcgaaaatcaaaacccrttaggcaaaaggcagtgtgattgattcttgtttagaagatggggacagccccattggtgtgacagggttgcggtgctggggctaccacggggctttggctttctcggaaaactcgacaggcttttctcagtaggagagacagggaactgatttgccagcccaggagtgtctgtgatccctgggatagtctcaggattaaagccctgagataacttcctaatttccagggtagcttatgtttgttgtgcccagcactgattagtggtgcttcatatctgctatctcattgaaattcctccaacagggatacaaccaggtagtatgccagttagggatgctttgggctgcragcagcagaatagaaaactcaaagyagcttcaataaggaggaagatgcatcattgaatataatatgaagttccaaggcagttggttttaggttgagttaatggctcaatgatgccaccaggattctagattcttttcatctctctgctcctctgctccccaacccctgcaagtggcttggtcctcatgcttgatgcttcatatcacaagatggctgcccagttccagccctcagacgtacattcagtgatgtttaayccgtgaagagaaacattttctcctatgctccactttctttcttttgtttttgaaatggagtcttgctctgtcgcccaggctggagtgcagtggcatgatctcggcagctcactgcaacctccgcctcctgggttcaagcaattctcctgcctcagcctcctgccgagtagctgggattacaggcatgtaccacaatgcctaggtaattttggggtttttagtagagacagagtttcaccatgttggccaggctggtctcaaatgtctgaccttaagtgatctgcccgccttggcctcccatagtgatgggattacaggtgtgagccacagcgcctggcccactttctttttttttctgagaggaaaccctttcccaggagcaccctagcagacttcttttaaaatcccattggccaggacaggtcacatgctcatgctctagctctgagggaacctgagaaagcaagtgtctggcattttcagatgagagagggaatggatctgataagtggtatgaagactcttttacagaacaggaaatggaggctctgagaggcgaagtcacttgcctgagcccacacagctaggttctcagtaaatatttatcaaaggaatgaaaattgcagagccaaggtttgaacccaagtttgtctggttcccaagcctatgtttctaaatcctgggaccttgggtggatcattttagctctcaggtccagtgaattcatctgcctgatggtgataatagtcatagctccctttcagggctcttttgatgattcaatgagatttcagatgtgaatgtaatttgtaaatggaaagtactttataagtatgaagtattattgtattcaaaagtgggagtggcctttatttatttatttttaattttttaacttttttcagagacagggtctygctctgtcacccaggctggagtgcagtggtgcaatcagagctcactgtaacctcaaactcctgggctcaagtgatcctcctgcctcagcctcctgagtagctgggactacaggtgcacaccatcactcytggctacattagaaatttttttttgtggagacagggttttgctacattgtgctggctggtctcgaactcctgggttcaagtgatcctcccatctaagcttctcaaagcactgggattaaaggtgacagccatcatgcccagcttagagtggcctttctttaggaacagtggtcaatatttttcccatcacagacttgattaagaatcagctctggagtccaacagatgcggttgatttcttgtctccattgcttaccatgaatatgaccttgggcaagcccctttccttctctgagtgtcactttccttatctaggaaatgagaattataacagaggcaaccatgaagagctgttaggagatgcccctaatgtaaagagcctagcccagcgcctgactcatgggaagcattcagtaagtggcagcaacgattgttagtgttttcacrgaattcctctgctccagctacacgtctctagtgtaatgaggttccagcttccttgacctgagccacaaggatctgtgtattatcatcaaaagaaatgcgggaaccaactcagaatctatggggccccttcagtgtgatgagtcatcgacttaggctcttgctggccccagcttggtcaaaccagatgcctgtttttatcctggcagataatatgccagcaattctgaatcctgattgtggggtcacacagacctggcttcgaatcgcagcccagccttgtcctagctgtggactttggccaatttgcttcacctctcatcacttccatttcctaatctgtaagtgagggcgataataaaacctactccacagggttgtctgaaggatgaaggatgatagcacatgatcagwgttgaagctgtgcctgagaaatcccacatccccacaggataaagaaacccagagacccaggatgctccagtgacctgctgaggatcacacagcccatcatagcctttcaaatcccctgagagaccagctgctaagagatgatcctggtcaaacatcctggagtaacagaaagatccctgagcctcagcgggtacgggtggcggggccagaaaggcctgggcatggcccctgatctttcaccgacttgctgtgtgaatgtgaaatgctaggaagaaaaagagatggtcaaatgaatgggttggccaaagcttaactaactagaagagaacaagcatgcgttaggcaccaactccatacccagcactttgtgtacttccygtacttgataaygtcatcwggatgggaagcacttgaccttagcactggattgcccaagttcagagtttggcttctctactcactaaccatgtgatttggggtcaactattgcagccctctgtgccctggttccttcagccaacagcaattttgggccaatcactgtgcctgcctcattggattgagttacatgcattaatgtatgcaaagcacttagactaggacctggtatgtagaaagctctcaataactgttgggttttgctgttgttgttttttttcttttttactgtcctctcatgtaatcctcctgacaatcctgcaagataaataagctccttttcaaaaaactgctctcatcaaatgatacctgctcattgtaaggttagaggctttctctggccactggagtccagtaaaggcagggcactaacaccccagcaggaactagtgggatactcacctgccggctgatggggacgatgtgtacgtgcttctcccctggctgggggtataactcagaggtgtgtgttctacactggtccccagggcagcttcagttgctcacagcaattacttgtttgataacagaccctgtttgacctctttcctatccctgtctcatgttccctcccctcttccagagttttctgggatcacttatcatataagccacttgtactcagaaccttgtcttaggatctgagattctggggaaaccaaccaaagctctgtaggacatatcatttattcagaatgacctggtgttgtattatagacagcccacccccgatagagagaacctctaggaggttgtcgtaaaagaagaaattctaggtctggcagggcacagtcagcctcatctctgtctcttagataaaatgaaaaccacagtggtggcagcaacagctaacactgagtgcttacaatgtgcttgcctggcatagtgcaaagggcattaaatgccccatcacatctgattttcacagcccccccataagggagggataactaccctcatcttacagccgtggaaactgaggctcagagaggggaagtgtctggcccagggtcacacagtgaatggaaggctgggacagatcccacccaggactccctgactgcccagcccatgactttgatctctgagttgtatgagtgaccttcagaaagtgagaagcaagatcccagtattcccttctcatgctggggcagtgctgagaggagagagatttgtccagaatcaccctatgacttaggagtgttcttagctctggatctaggacgactttacccccaaaggctcctggatgggactatgggagagacagatttagcattaagcattattttaatagataaactaaatgcataaggtcctaccttctccctgaggtgaaatcaacttgattttggtgtctccagcaggagtgggcatgactaggtggggccagaaatgggaggaatctctcagcccccgtatcgggagtgggtggggtgggagctagaattctcatgttaatatccagggcgccaatgctccttaaatgttttctctgatgacataaataacaaataagatgtaatgttgccatgtgagacacacttctgtggacctgggtacaggcctggattcaaatcccacctcctctgcttcctggctatatgagcccccaaggcgcctcacctctctgagactgggaggtgggggtaatacctggggcacacctcacagagtagcgcttctccatgctgcctgcacataaggatcacctgggctttgcaaaatactcatgcctaggccccacagttgaaactcaccccctaagtggtttctttttagttctggtaaaatacacataatatgaaattttccatcttaaccgttttaaaatgtatagttcagtaaagtatattcacattgttgtccaaccaatctccagaactttttcattttgcaaaactgaaactctgtgcccattaaattctcctgggcccacctcctaggccctggcaacccccttcctactttctgtccctttgaactcaactgttctaggtacctcatataagtggaatcatacagtatttgtccttttgtgactggcttatttcacttatcatgctgtccttcagcttcgtccatgttgtaatgtgtcagaatttccttccttttaaagactgaataattttccattgtatgtatacactacattttgtttatccattcctccatcaaaagacacttggttgcttcagcctcttggctattgtgaataatgctgctattcacatggggtacagatatctcttagagttcatgctttcaattcttctgggcatggataagcagaaaccaactagatttttaacaattcttttgggtatatactcagaagtggaattgctgaatcatatggtaattctattttgaattttttgaagaactgctgctctgtttttcatagtgactgttaccattttacattcccaccaatggtgtacaagggttccaatttcttcctatctgtattagtccattttgcattgctatagagaaaaacctgaagctgggtaatttataaagaagagagttttattttggctcacagttctgcagactgtaccagaagcatagtgctggcatctgcttctgatggggcctcaagaagcttacagtcatgcagaaggcaaaggggaagcacgtgtgtcacatgaagagagagggagcaagagagaagccaggcctttttaaacaagcagatctcacaagaactcattaccgtaaggagggcatcaagccatccgtgagggatccacccccatgacccaaagacctcccactaggcaggcccctcttccaacattggggatcacatttcaacatgagatttggaggggacaaatagccactatatcaacatccttgtcaatgcttgctatttttttgtttacgtttttttttttagtagctatccaaatgggcatgaggtggtatctcattgcagtcttggtttgcatttccctgatgtttagtgacgctgagcatcttttcatgtgttttttggccatttgtatatactagcacccccttatcaggatgcctaaacctcggatagtaccaaaccctgtatattatatgttttttcctacacatacatacctatgataaagtttaatttataaattaggcacggtaagagattaacaacaaaaactaataataaaatagaataattacaacaaaatactataataaaagctatgtgaaagtggtctctctttctcaaaatatcttatagtatgtaatacttttggaccacagctgactgcaggtaactaaaaccttggaaagtgatattgctgtgataaggggggactactgtattttctttggagaaatgtctactcaagtactttgcctatttttaaattggggtttttgttgttgttgttgttattgagttgtaagaattctttatatattctggatattaatccctaataagatatacgatttgcaaatattttcttccattccataggttgtctttgcaccctgttgattgtgtccttcaatacacagaagttttgtattttgttgaagaccgagttgtctgttttttcttttgttgcctgtgttttggtattatattcgaggaatctttggcaatagggggaaatcataaagcttttccccaaattttttctgagagtttgacagttgtagtcttattttaggtcyttgcatgtggtgtgtaagataaggaaccaacttcattccattgcatggggatatccccattttccccacaccatttgttgccctgggtgattctgcacacggccaggaagcccagccacagaagacaacatgggatggcggagatcagaggtgctaagctgtggagcaccatgtgcagtgctgggaacagagggagtcgccatctggggcagctgctgttatcattgttgccaggataaggggcaatctctgacacacccagcatggctcatcccttcctcttccactcaggacggcttggcagaatgcaagtgagagagtgagatgcaagtgkgagtgacgtgtctaggttgtggccacttcttgccaccccactgctgccttcctgaccytatcctctccctcckgtaccattgcaggagcctctagtcccatctgctgcctccagcctcccatccccygtctggtctccacacacagcaactcacgcccccgctcaaaaccctcctatggctcctgcctcactccgagaaaaagcccaactcctcagtcccactcacagggcccattatctggcatctttccccttttcccagcacccttacagcctccttccctaccactctccctctccatcactctgttgcatccacagtggcctccttgctgttctaggcaccctcccacctcagggcttttgcacttactgtccgtcccttctgcctggtacggtcttcctgctgatgccacgagactcacccctcacattgttcaagtctcagctcaaatgtcatctcagcaaggccatccttgaccaccacatataaaatagcactgttcattccccatggctgctttatttgtttcaacctgacatataattacytaattatatgattcctttctctctctcccactttgatrtaagcttcaaagggcagggattttgtgtgctttgtccactgttgtgtcttcagtgcctgccatagagcaggcatgaaatacatgcattgaataaatgaatgaatgatgttatcctagagataactgagaatactaattgatgaaaaaggaatttgtttacaaactttgggactttcactcttattactaacacattgctagaagtctgactctcagctgcttatgccaggctctggatgaagaatgtgtctggtttttcaaccagagcccagtttctcaaccttagtgctactgacatttggcgatggagaattctttgccgtggggctgtcctgtgcattggaggatgtttagcagtggagaatggacattagagaaagaagggataagccgctgccaggaggatattgcattattccaggaaagagaagaaagatgacagcccagaagagggtggtggcagggaagatcggtgaaaagtggctggactctggatgtaaggtgkggaggcagctcctgggaagccacaacgcccctgcctccaccagtggtcacagaccctcaggctgtgcaatgggtcttaagccctagcctttttttaagctgtgagtccttgggtcacgtagctgtttcctcatctgtaaaatggacctaatcacagcacgtacctcataaggagattgtaaggatttgataattatggcaaataacagtaacagacacataatgcccaacaggtcaataacaaacttttattatcaggattggttgtgtatattcattcagtggaacttattgagcacctactatgtgtcaagcattgtgctgggtgctggggacaaagcagagatcaaaacaaagatcccagctctcatggcactgatattccagtagaagaaggagcaagactgttaaaaaaataaacacagatactgattggaccaaaacaaccatgcaaaataaatcatgagactgtaagacaatcagggaaagaaagatgaatgctaactgaatattggatgatattgaggaatgaatgctgtgtttttagatgtgataatgctattacgactatgttttaaaatctttatcttttagatacacatactgaagtgtttatggacgaaatgacaagatcraataattatgtagttttttttttttttttgagacagagtcttgctctgtcgcccaggctggagtgcagtggctcaatctcggctcactgcaacctctgcctcccaggttcaagcaattcccctgcgtcagcctcccaggtagctgggattacaggcacccgccaccatgcccagctaattttttgtatttttaatagagatgggatttcaccatgttggccaggctggtctcaaactcctgacctcaagtgatctacccaccttggcctcccaaagtgctgggattacaggcgtgagccaccgtgcccggcctgmtataatattttggatggcactgtggagaaagttctgcagggaaggaggggagtgctggggcttaaccaggctggtcaggaaaggagaaggtgccaagtagaaagggagggagacaggcatgtkggcatgtgggggaagagtgctctgggtggagagaaaagcagtgctaaggccctggracaggaacgtgcctggggcactcaaggaacattcaggtattaatgtggttggagcagagtgtaccggaggcaagagagtagaaggaggtgagatcagaggtgcgaccttgtgggtcactgctgaactctgacccttcctgggagcctctgagccccagaataggctccctgcttccagcctttcccatccagttcaacctctgcagagcagccagagccgactttctcaaatgcagtctgctcaacttcatcacccccttcccaaaacttccatagttcccactgcccccaggatagtccacactccttagcctggctttcgacatcccaacccaactctccaccttcatctcctccccatcccttcttcagacaccctctgcgaccaccacactaacctttctgcatgcccccaaaagctccagccttcctcagcgctggtcaccctcttgcccaagctgttcctctgccttgcacccatttcttcctcttctctgcctgcagcctctctctttccaccttcaaggcccagcttccccaccacctcctctgtgaagccttctttaaccaccccccgcccccctaccaccacctacacttcccttcaggcagcactgactgctccctcctctgtgcaccggaaacctgacgttcataccttcctcgcacaaaacatcgtgaaaattcacttgtgggttgttctgtggatgccaggcctggcctacagagaaacaggaaagcttaagcgtgcaggctgtgcagcctgactgcctgggttcaaatcccagctcagccacttttgagctgtgtgccctttggggaattacataacttctctaggtttcaatgtcctgatccgtaatttggaaagcctcataacaaccagggttgttgggcaaattctatatgaaacactcaagccgtgcctggcactcagcaggtgttcagtatatttcactattactattgttactgcaggtaggtgttggtaaacgtttgttgagtgaataaatgagcaaatgtgcatgatcttgtgatgactgatcagaggggtcttccttaaaaggtaagggtctcttccaggtacaccctgctccttccacctttcttgtctctacctgcctgcagaaagaagtggccttttgccttccatttacagagaggagacacacaattaagttagacacttgaggtgttccctcacaccctgactgtttttgagacaaggtctcgctctattgcccaggctggaatgcagtggcgcgatcatggctcactgtaaccttgacctcctgggctcaaatgatcctcccacctcagccccttgagtagctgggactacaagtgtgcaccaccgccacacccggctaatttttgtactctttttttgtagagacagggtcttcctatgttacccaggccagtttcaaactcctgggcttcagcaatcctctcaccttggcctcccaaagtgttgggattacaggtatgagccactgcacctggcagctgctccatttttgctctgaaatgagactggtttctaccacaactgcccaccatgggctggcaggcaggcactgtctttgagagaataatattgcatttgccaattccacaccatcacttacatccaccaggtaatgggcctagaaccaaacagtttctaaaaacagatcatcaattgtcactaatcactccctacaggccatccctgagtctttctaagctttgtgtgatccttggagcccttgagcttggccagccccacctctcagagtctttgtagactcagttgtaccgaagaggcagccgatgattgccctgtcaggggcatatgagaggcaaaaggaaagatggagacaagacaaggcagaaccagcctttcctttgcttatcacttgtctggaattcccactgtctctgtgaatggatcgagtttcttttatctcttttcagtggatacatttgcacaacctttattgtttcttgaaatagtgactgtaattcgactcagtcattcctcctgtttctagatcattctttctgtttcaaggtggcttccattctaggcttctctggtccttctaagtttaggtgggagtatgtgcatgctttgaggacctgtttcaatcctgcctgtggtttgtctgataaacaatttagtgcatgttactgtgggccaggcaacctgctgggtgcttgaaaatcacgtgtgtatctatttgttaggattcttctagctgcaggtgacagaaaggtagctccaatggacttaggcaaaatgttaaaaaaaaaaaagtcttgggttgggtaaggtttccagcaaggttggatccaggggcttaaatatgtcatcaagacttggtatcctacatctctaagctctattcttctttgtcatggcttctcagcaggctgcaccaacatggcaggaaagatggccccctcaaatccaggctttcttcctggggcaaagcaagtctcttttccaataggcccagcaaaatcccagggctgattttcattggcccagccctgagccaatcacatagctgcgtctgggtcacatgtcaatggctggagctgggatgggattgagaatgggaaagaggtgctttcccaaagaaaaattgaagtcctcttaccaagagtggggagaataaatgtaaaccggcagaaataatccatggccatcatagagtttataacctactggagggagatacgcattaaacaaattaaaaattaaatgaaagaataatcacactaagtgtaatatgtatgttggaaggagagaaacaaggtgttttgacagagattaatggggcaaggtcaaagaaaacttctcagtgtatgtgaacttttctgagagcgtgcacttttctgagagcctgaacttgatgtctgccctgctgagctacaggagtgatctttctcctataagatcgccattccgcttatcctgcactgttcagtgtgctctctctcgtattctattttcttcttaacttgtttcatctctccacataaaacaggatgttctcaaagyctaagactgtatcttactcacttctgtgctcaaaacagggtgggtgggctgcctgttttgtaaatacggttttaatggaacacaggcaggcctattcattcacctgccatgtacagctgcttttggatgtatggccataaagcctaaaacgcatttattatctaaacctttatagaaaaagtttgctgacctgtgttctgaagttgcatcagggcctggtgcagaggaggggcttattgggtgtttgtgggtggattggtgggaaggaagatgcaagctagctgtgtgaccttgagtgaatcacttaacttctctgggcctctggcttcatatcttgcagtgtcagccagccccttctccttcttcagatctcagctcataggtcacctcttcagagaggccctccctgaccttgaatggccagtttggacttggtaatgtttacagtcttcccatcataacatgtttctctggtttattttgagattatgcccacttggggtaggcatctttccctttctctgcaccaatgtttttcctcctctcatgtgccgtctccctggcagggtaggtggaaagagctctggtttggaactctggaggtctgggttcatactccccacatatgagcaatgagaccctgggcagacccttcttctctctgagtttccatttccttggctggaaaacgggcatggtgactttaccaagcaaagctactggaaagacaggtgtacttaaccgtgccagagggcccagcactgtgctgggctgagcacaggtacttcattcgtgttaagttgtttttccttctctccttcctctcctcaagagagtctacccctgaccttgctttagtcctgcccctgatgatacccttgcctgctcaaacccttcatgcaatgactgtgccaaggaatggttggagaggaagtgttagatacttcctccacctcccacccccaggccccatcacactcccccattctttgatggagcgtcctccatgttacataaagctctatgcaaatgcaacccaagaaaagtcctcttgttcccctccccaccccaggttactgtccccaagcccctcttgtataaaaatttgggacccttgctggcctcatgcctgggagaactggccaatccaaagaggtggttttctagatggatgagagcagtccttgggggcagggtgtatgggggactgggtgtccctaattaccaagtgacctactggcagggccagctacagaattcgtggggtgccgtacaatataaaaatgcagtccccttgttcaaaagtaagaaagaattttgagatggtgatagcagagtagcaaaccgagcatggagcccttgtgagcgcagggccctgtgcaactgtgcaggttgcacacccttgaagccagctctgcccgcagggcagaatgactcagaggtccttatgggttaggaggagaaggccttaacctccctgcctaggcaagagccggggcctcagactctgatggctaccggagctaggtaggccttgtcacccagtgaagcagttgctggaagaactgtaggagggcaagttcaaggaggacactggtcaacacccagcctaacatgcctattccatggccagccacttttcaggcagggagtggagggggctagtggtgaactggagcagaagcctgcctgagaaggcagcagccattcagctccagactgggtctggacttagccagaaattttaattttcatgggagctatcccggtttttcaacgttggcaaatcattttaaaagttaaaaacatgcccaagtgcagtgtctcattcctgtaatcccagcacttacggaggccaaggtgggaggatcccytgagcccaggagtttgagaccmgcctgggcaacttagtgagaccccatctctacaaaaagtagccaggtgtggtggcatgtgcctgtggtcccagctactcaggaaactgaggtggggggattgcttgagcccagggagtcaaggctgcagtgagccatgattgtactacggcaatccagtctgggtgacagagcaagaccctgtctcaaaacaacaacaaaaggccgggtgcggtggctcacgcctgtaatcctagcactttgggtggctgaggcgggctgatcacgaggtcaggagatcgaaaccatcctggctaacacagtgaaaccccgtgtctactaaaaatacaaaaaaaaaaaaaattagccgggtgtggtggcaggcgcctgtagtcccagctactcgggaggctgaggcaggagaatggcgtgaacccaggaggcggagcttgcagtgagccgagatcgcgccactgcactccagcctgggtgacagagcgtgacaccgtctcaaaacaacaacaacaacaacaacaacaaaaactccaatactgtggtgactgtctttgcacttaacatctgtgtgtgtgtgtgtgtgtgtgtctgtgagtatatctgtgggagaaatctctggaagtcagattttataacagatttgtgcattttacattttgatccatatgaccaaactgcactttgtagaggttgtaccaatttattctcccaccaacgatgtgtgagggtgcctgtttccccacaacttcatcagcaccatgtattgtgaactttctgatttttttgtcactctaacagatggaagcgggtatctcggtatggtttcaatttccattttaaaatgaagagtgaagcaggtaccttttgcttgttgagtgaaacagcatcagtgtcacatgtcaggaagctccattgttttcctgtctcaaaaaaaataaytgaaaacaatttgagtgggccaaacagaatatgtttggaaccatatgcagccctcgtggctctaatttttgacctctggagcatagagccttcacgtggctggaaatgttgggggtgcatttcttgcctctgaggcccccacctggaagggaggaaagagacagagcttggwtgacagaagcaataggtcccctgtattaattaaggttctccagagaaacagaatcactaagagatttgtttatttattcatttatttgagagaccgggtctcactctgtcatccaggctggaatgctgtggcacaattatagctcactgcagcctcgaactcctggcctcaagcaatccttccgccttgacctccaaaatagctgggttacacgcgtgagcccccatgcccagcttcccagtaagacatttattctgaggagttggctcacatgagtaaggaggctgagaagttccacaatctgaacattcaggagaaagctggtgatgtaatttggtctgagtcccaatgcctgagaaccagagaagccgatggtataaatcccagtgcaaaggcaggagaagacccatgtcccagctcagaaggcaggcaggaagcaaaaggggcaaatttctccgtcctctgcctcttttttttctattcaggctctcagaggcttggatgatgtccattcacattgggcagggctaggtacttttctgagtccaccgactgaaatactaatctcatccagaaacacctgcacagacacacaaataaatgtttaatctggccaccccatggcgcagtcggattcacacataaaatcaaccatcatatcccaccttccctcttcttatttctggcatcaagcacaacctcgggtggcaaatctttgttgaatgaatgactatccccccaaggcgggacttggctccaaaaatcaaggcagttcatgcctgatggatggcaacacaagtcggggaaattctcaggcaaatcgtaaattgattagctaatgagttacaacttcccaaacccaatctccaaccagggcaggaagaaacagctactgcagtggctagaaaaagctctcgatgtcacgtcagcaaactgaactggctctaggcctcaggttcctaatctgtaaaatgggaataataagatccctggggtgacccagaggatggataagatgaaacatgtaaagtgcacagcaaagtgcctgatgtgtaacagatgtaagccagtattatttgtgttgttatcatcatcatcatcatcatcatcatcattatcatcatcgaagcatttggcttatttctaggggctgtgggcctgtggaaaagcttattgtgtagaattaaactttgtatcctgtggagtcatgtcagctctactatttcaggctggaaagcttgggcattgagagattcagtagagattagggggcccaggattgggattctggtgctcaagattgctgctgttgtgtccagtattggagcaacatcattcaaggtcacaactctgaagttcaagatcagacaactgccatctgaggtcagaatcctctaatccatcattggagccaaggagtccatggccagagagttgctcttcataattaaaactctagcgggcaaggtcagaatgctgatgtcccagrttggaactaatgtacggggttggaattctgaggtkcaaggtcagaacwcttcggcagtcttcatgatcagaattctggcaggcacattcagaagactggtgtttggagttggaagtcttattccctgcttgttatattgggagtctcatctcttctgtgtgtccttaacccttcatcatccgtcttcctggcagcagttattgaagaaatgcaaatcacagaagatccccaaacccccatttatccagcggggtcctgatacataggcctctctctcttattgtgtctgatgcccatccactcaggtcgtgctgataagggcgacaggatcctcaggaaggtgaccaaagtgtggcccccttaccccacccctgccaaagaccctggaacctgttgtcaactctgtttaaatccacccttaaatccatcttgttggctgacctggagcagatccaagtaagcagctctgccaagcccctggggggcacctggatgatctcactgctccatcatccaaagaaaggcaaacactgtcaggcaaggggcagaagaaagtgccaagggcttgcggctttccagcccgggagatgggctggcagcagaacgtggggaagtgcaacagtttgttggtcactgcggtcaccacaagtgtactgttggtgccaactggagagggaggtttattgctcatggggtggagggagctaaaaaataatctttaaactgtatttatgatggtgcaagtaatgagtgctcagtggaacaagggcgggcaggaaggattggcttggtcatgttcscaaggaaattgtaacacacctcccgtccctgcctttatgctccatttctcggccttcctttatttttttcatagcccttttgccacgtgttatcttataggtttatctggctcttatctgtctcatttcactacagtatcagctccattagaaaggaacttggtcaaattttactgctcactccccagtgcctaaaactgtgcctcacacagagcaagtaataaatatttgttgagtggatgaatgaatgaatggatggatgattattaccccttcagagacagtattagagttttctgagttcccaaatcattccatgcatggcccacctccaagcctgttcgctgtgtctccagattttgtggatgggggtgaggggaaacagcaggagggagagggattggtcactccacggcttcttgttgctctcgggataacttccaaaatctttttctggccaccaaggccctggaaggtctaccaccctaccttcgtaacacatgcctgttatcttgcccctttttttctcctagctgtactagatagctttctcagagcgtcassacgtggtgctgggtcacaactcagggcctttgcacatgctgccatctgactaggatgatcttatggcccctaccctggctcccttggcctcccttactcatgcttcagggctctgcctaaacatcccacccctaacttactgaacgtgatgtcattccctccatgataggccctggtatttcttgcaagagtttatccatagatccccttggtcactgttttgggttccagtgttcatcactgtggggataaatcttcyctgaactggaggttctttatgagggaggtagccagagccctttccctatcactaagaaaaatgcagaaactcgcttcttctcccagaaatgaggcattctcgctctagcagggaggaattttggtctcccaggaagatttcttagctgcctctccaaagcctgtcccatactagccccatcacaatggggttctctgtttcctctcaccgtccagctgtccaggctaagtctatggcttcccccaggacactgcagaggttagagggtgcaacccagcctctgaagacaatggcaaaatagctaacactcatataccacgttttacacacatcgcctcatttaacccttacgacatcctataaggaaggtattattattatccctattttacagatgtggaaactgagtcccagagaggttaagtaacacatgcaaggatgcagctaacaggtggcagggtagcatttgaaccccagttgttacccccagagcccaggccctgaaccactacaccccctcccctgtccactccgtttcctccccacagccttctcctcacttacttcttccttttattcttagtcttcttgcctttctctttgctcttcttccttttctccttaagtaactcaaactccccaagttataagcaaccccaattgtatggatgcgttgttctatttttcaaattgcaaaaatcrtaagagcagtggaattttttcacatccttatgctataagcgagggtggatggaaaggtgggagttttctgtttgatttgctgcagaacgggttgggaggagagggtaaatttcctcacagtggcctataagactccatgaggccagagtcatttaacactctctgacttcatcttccactaccatctcctgcctccccgtgtccagccatgctgatctcatacttactattataaattccttcctgccttgagtctttgcacatgctgttccctctgcctcgaatgctcttcctctcttcttcatccagttatttgcctcctcaccctagagctcccagatagaatrccacctcctcctgcaagcctttcctaatctctcaataggtcagatcccccagttatggattttcaaagttctctgtgtctctcttgggtggcctccattccagttgtaatttcacataggtttaagcaacgatctgattagcgcctgcctccccatctgggctgtgatctccccagtagtaggaccttgtctgctataggcatgtctctcctgcatctagcactttgcctacctccatgcaaatcttccataaaattttgctggatgaatggatggatgaattcagaggttagtcaaagttggcagaaaccacaattcaccttcctttggttgaggagtggtgagatggtctgaaatgttcagctcgaactccagccagaagtttcttatcatccactgaaagcacagggcactaaattctttacaagtggccaaataccttctccagtgcccagaatgtgttgaatgatcattacagtgtcttctatcagcttttcaaaggtacctatttgggttatattttatggggtgccattacattttacttaagtaaaccctacgtatgaagactcaaaacccaggaaacagaagttctgagggaactataggcagtggctcacgcctataatcccagcactttgggaggccgaggcgggcagatcacgaggtcaggagattgagactagcctggctaacaaggtgaaaccctgtctctactaaaaatacaaaaaattagccgggcgtggtggcggatgcctgtaatcccagctactcgggaggctgaggcaggagactggtgtgaacccgggaggaggagcttgcagtgagccgagatagggccactgtactccagcctaggcaacagagcaagactctgtctaaaaaacaaaaaagaaaaggaaagaaataaaatgaagaatcccagggaattcaccagaaatgtggtttagcgggaagttgtactacctttgtgggcaggtgggcctagttcaaatccctgctccaccactaatgccggtggccttggaaagtcattcctcatctctcagctgacattgcctccagattccaccctcccagcatgaaggccagcagataaaatggccatttttttcctgactcttcccatgaagattgcctctgactggacagacttgagccacatgatcatctctgagccaatccctgtggccagaagggatcatgagtgagggaaccagtttgggtcagagaccaccattaggtccaggggaaatacctgaaataggatttgcttaatagtcttctttagattaagtcattaattttactaaatcgagttgttwtaacaggaaatttgatattatgaagaactggtgccatttgccataaatcatgtcataaaattccagccagatgctgaagcctgatacctactctctgggttaaaagggaagatgtgtgttagagaggtgttaaaatgtcactggcttcatactgggactttccacttcagggagtctgggggtctgaagacaattggaaagggtagcaccttctcactctgtgaatcaatgtgattctgatggcttgtccctgggcagctaaaccagtcttggctgcacatgagaatcagctgaggatctttgaaaaatcccaatgccagaccacccgccagacctgtgaaatcgggatctctggggatgggacccagggattggtgtttttcaaagctcgcaaggtgattccactgtgcagccaaggttgagaaatccagatttcaatgtawctaatactggtggtgtgtgccccacattgctacccacaagggttcagcaagtccattgggctgcaggaaggggcttattggagactggggtggcctggctggccaaagagtgtcacagaaaatgggctcctgtttctccaaagcattagctgaacaggagtctgggagagtcatttaacactctcaaatgggaagaaaccacatgtctctctcccaagtccagaaggatttgattcccaaaatgaaattcaactctgacctggatcctacccgcactgtctggatccaattgcttgttacctgaaccagctgttacctttccacctatccatcaaccatcccagacccagctctgctgcttcccagctgtgtggcctcaggcaaggcactcggcttctctggtcttcgggtttctcatttgcctaacgggggtaggctgctgggctctgtgatctttaaagacatttccacttgggaacctgcaagtcttgagaggcagccacaggctctttaattggacacccaagccctaggtcaggagttctcaaaacccaggcagttcagattccgggtccatcgcccagaccacagaatcaaagtctctagaggcagcccaggatctgcatccctaacaaggatctcaactgattctgacgcaggtgatcctcaaaacactttaaaagcatattgcctatgcctcagtgttcatcataaaagccccttatccagagatccagcccacacgaaacatgccctcctttttgcaggtgaggaaactgaggctcagagaggcaagtccttctttacctgaggttctgcagtgagtccacggcagagctgggattcagacaatgaccctgcctaactccaaagctggtgtccttcccctgtctatgtgacattcctcaaacttaacatctccaaaactaagccccacgtcctcccactgcgaactcgctcctgccgatttccccccatctcagtatctctttccagccacagaggccaaaaacctgggagctactcatgactcctcctttgttcacactccgtgtgggacctctgcataaatcccaaggccctgctttcaaagtgtatcagcctccaaccccttttcatcacccccatgaacactcctgaccaagagtcggcacgcttttcttgaaagggccagatagtaaatatttgaggtttgcaggccaagaggcaaaattgaggatattctgtaggtacttacataatcacttaaaacggaaccatttaaaaatgtgaaatctgctctcagcttgctctcgggttgtacaagcaggtggcaggttgcatttggcccgtgagccatagctggctgactcctgctccagaccagaagttctcaacggggggtgatttttgcccctcagagagcatttggcattgtctggagatatttttggtatcataccaggtgggatggtactattggcacctagtgggtagatgccgggatgccgctaaacatccacagtgcacaggacagccccacaacaaagattcattcagcccaaatgatgrtagtgctgaagttgagaaactctactttaggaccaggtacggtggcttgtgcctgtaatcccagcactttgggaagctgaggcaggaggatcacttgagcccaggggttcaagaccagcctgggtaacatattgagaccccatctctacaaaaaataatttcaaaaaattagccgggcatggtggcacatgcctgtggtcccagctacttgagaggctaaaatgggaggatcacttgggccccagaggttgaggctgcagtaatccatgattgcaccactacgctccagcctgggtgaaagagtaagaccctgtctcacaaaaaaaaaaaaaaaaaaaaaaaaaaaaaaaaattctactttagagcaagccactgtcatttctcacctggactattacagttactttctcgctgctcacctgcatccacactcacacgcttccctgaaagccagagggatcctgtgagaacccacgtcaggtcatgtcacctcccactcaaagccttccagtggctcccatatcactcagtgtaacagcaaagtcctcatggccctgcaggacctgcccctacaagacctctctgacctcatctctccgtctcccattgcaaatctacctgggggagcttagcatcggctattcccgctgttccctgcacgacttctctcacctccaagttcttattcaagcatcctctctttaggaagtgacaccttccctgaccctctattttcaaatggcagtttccacccccagccttccttttttttttttttgaggcagtgtctcactctgtcgcccaggctggagtgcagtggtgccatctcggctcactgcaacctccgcctcccgggttcaagcaattttctcgtgcctcagcctcccgagtagctgggattacaggcaagcaccaccacattctggctgatttttttgtacttttagtagagatggggttttgccatgttggccaggctggtctcaaactcctggcctcaagtgatctgcctgcctcagcctcccaaagtgttgggatcacaggtgtgagccaccgcgcccagccctcctgccttcttatctcccttccctgcttcattctttttctccacagcaataattacttccttccccaaccccctcctcgcccacctgaatatgtgctccatgtgggcaggggtttctcttttgtttactgaagtatctcaggacctgaattagtgcctggcacagagtaggtgcttcatcagaatttgctagtgaagtaagttagtgcacttctctaggcctcagtttccccctgcgtcaaatttagcccccaactcacccacctccagatgctgagctattagattgtttgctcactgtagagtgctgtacccaggtgaaaggggttcagtttggcatgggtggtgktgaagtgtggccctgctctaagcgctactcagagccgaagcatccaggtcgttttgcagctggggtcagggctgcagccaggtcctcacctaccccaaggctgctccactggtacctaatttcctacaccttctcacaatctcaggtctcgccatcctctccacggtctgtcgtggggcctcccgtgagacctggtcaagccaccttgtctttcctcaccttgtaacttcatctgcccagcctggtcctcgagccaggccccattctgtcttcccctggggaggccccctttgtgggtacattagctcagagagcctgaaagctacaattctgaagttctgccctcagtgtcttgaaggttctagagtcctacaactggaataggcacagcttgcatgctgtgagcctagatgtgtgagcagggctgttgttttgttcgtacactggatgcaatggccgtgatggagggtggtggaaactgtatcttggttcaattcagtctcccttttcttctaagggttgaccctaagtttgggaggtttaggtagtgatgaattaatacaataagaggacacccaacattttaaaataactaaaagagtgtaattggattgtttataacacaaaggtaaatgtttcaggggatggataccccgtcctccatcatacgattatgaggcattgcatgcctggatcaaaacatttcatgtaccccatagatacccctactaagtacccacaaaaataaaaaatacacacattttaaatttaaaagaaaagaggacagccagtgtggtggacactgtgagttcctcacctacactccatttacgagctggtgcacccacaccccaactgctggcattccccgctgctaacagttcaccactgcccccttctcacgactcctgcctctcacaattgcccttggcccatgggagtcgcctgccaggggattttaacctgtggcagctctcccgtcctcccaccaggcagactgtggactcattgagtcaggggtacaaaagctcagccctctttctgcaaggtgggatcaacacctggtgcaattcaggccgaagctagacctcagctgaggctacatcctggcttagctccttccctatcctgtcctgcttctctctctcccccatctcctaaaggagacgtggagcaagaatgaatcacgtgcctaagaatccctgtctcaggctctgcttttagggatgccctgacatgaagggaggtgatcggtgttatttttttttttttttttttttttttgagacggagtcttgctgtctcccargctggagtgcagtggtgcagtcttggctcactgcaagctccgcctcccaggttctcgccattctcctgcttcagcctcccaagcagctgggactacaggcgcccgccaccacacctggctaatttttttgtatttttagtagagacggggtttcgccatgttagccaagatggtctcgatctcctgacctcgtgatccgctggcctttgcttcccaaagtgctgggattacaggcgtgagccaccgtgcccggccaatcagtgttatttaaaactgacctccatgcccaagggctggggactggcaactaagagttaccctcaggatgggatggtctccccctacctagcttcaccatcttcctgccttttcccttccatcttcagggtgggctctcattggcactgtccccacacccacagactccagtccattctccattttccctgctagactgaagagtttggctgtttctgctgacttggaggggacaatgaccagagcaggctgcagtccaagcatttgttcacgaagggctttgaaaggctggcccggtcctccctccccaccttgtttgccaggaatggtccccatcccagcgcaaaagctctggcaagccttgtttcctttcagccggcgttttctgagggttagcttggcaggcttccgtgctgaccttggatggcttaatgaagttgggagaggctccatgccagctccccattaacgtggcctttgagagagcctcaggggctcccaaatcttttggcttgctcaggcccaagggtagaggaggtgagccaggcaagggagaaaacaatagcttcaacggcaccaagatgctgtgtgaccttggatgagtcacatcctctctataggtcttgggtcccccagctgtaacgggagggcattgggctgggtgattcctcccaactccctgctgtactcattcattggaaaacatgtattgagtgtcaagtatgtgccaggcactcttctaggtgctgaggacatagcagcaaacaaaacaaagcatctgccttgtggaatagaatatccccagctgggggaatagaaagaatgtgggatttagaaccagaagaccagaatcttttgccactgacttctgagcctcagtttcctcatctgtaaaatggggctgttctgaggcatcagtgagatagtggatgtaaatgttcttggtagtaatcttatgcaatacttatttagcacctactgggttccaaggcatggacataatcaataattctcataatcccttcataaagagggataatggtggcaggtgaaggctctggagctggaccgggtccaaatcgcagctctgccccttcctgtgtgacctcagacaagctgctgggcctctctgtgcctcaggttcctttcccataagacaggtaatgatgatacctggattatagggttgctgggaggacagagtggactcgaacttgcgcagtccttagaacagtgcctactgcataataagtgctcaatacaggggagttatgagctgtatgttattattattcatttcatttcacaggagaaaacagattttcagttcttgtctgaggtcactcagtaagggaagctgaagaaaatrtggaaggagccccccacggtggctggacycagcatcaggggctctccccatctcctttagtcctctgaacccagagaggcttagctgaactgcaagctgaggccaagggatttacagctcagaaatccccatttctgaatgagtctgactgagtatccatgcacatgtgtgtaagtgtgagtggctgtgcacacatctgagcatccacaataggcattgccaagaaggacacaccatatgattccatttatatgaggctcaagaacaagcaaaattcaactataacaagagaaatcagaacagtgattgcttttggaggtattgactggaagggaacccgagagaacttcctggatgatggaaatattctggaccttaactgagttggtgggtacacaagtgtatctatttatcaaaaggcactgcactaaacacttaaaacttgtgcattttattatgtgtaagttatacctcaataaataaaggagcactgggaaaaaataataagagatctaatttactgaggagtaattaaccacatgccgggcgctgttcaagacgccttacaggtgttctgtaatgtaatcctaacacaaccccatgtagcattgcctgttatgtacatgcatgtactccatcctgtgcgtatgtgtctgaggctgcttcttagccggcgtatgagtagttcacagaatgcatatgcacacgtgacactgactcattcctatacttgggggctaagtgggcacgtatgagggtgcacgtgtccacagatttgtccacgggaatagatttctgccagcacctgtttgctcccctcaagagcattaatgaaccgtgcttcatgcgccgtgctggctggtagttagatgctaacagcatgcatgcaggggccctggtctgtgtagacaaatcaagcactgttatcagacaataatggcaggggatcgacagccagccgcctgtgccagggaggggtggggacgcatgagcactgggcaattagcatctctaaagggtgtctctgctgaatggtggctaatttgccgacatggccccatcagtcaaactcagcagtcactgagtggggaatgccgggcctctccaaagatttgtgagttgctgctgttggtgccagcttttgcactgggagcaactcataccttaagacctcacccttaagaggataagggtgaacagagcctgcctgcycacaacagagcctgcctgccctctgacctctccccacctctgaggatggttggccttgtgagcttgggatgatgtggaggctcggagagggcaagcaacctgtttagagtcaaacggccagtgggccaccaacccaggaactgagcttgggtttccagacttgcaggcattgtacatttctcaacaccatcactcactcacatgacacagtattcacaatatttttgccatttcttttcaccaaaggtactattagtttcttggtattttccctcaagtgactctctttttaaatttttaaaattattttgttttatttttactattattattttgatgcggagtcttgctctgtcgcccaggctggactgcagttgcacgatcttggttcactgcaacctccgcctcccaggttcaagcgattctcctgcctcagcttcccgaatagccgggattacaggcgtgcaccaccacgcccggctaatttttgtatttttagtagagatggggtttcgccatgttggccaggctggtctcaaacccctggcctcaaatgatctgcccgcctcggcctcccaaagtgctgggattacaggcgtgagccactgcgtccggcccctttttaaattcaaatgtttattttaaaaggaagctgccattaatggaaaaccagtatctgatacccataagttgaagcaggggtgaccaaccacccttgcctccattcacctgtgaactttcagttttaaaacctagatggttctggcaaactgtatggagttaatcaccttaaattgaacacagggttaaaaatgaataccacraaaataaactaggttattaaactcgaactggcagctctgagcctggagcctgtccttacctgtgctgaaggcggagctccattagaatgctggagcttctctttccggtagtcccatgacaagtcccagggttcactctgattggcttgattggggtcacatgmccagactctgccaatcgttgttgccaggggaatgcaccgttctgattggccagacctggagccagaggtgaggycaggctacaagccacgtggcttgagagctgggaagggatagttcccccaaagggtgagatggtttgttgctaaaaagaagccccctcttcctccaggtatgagcagcaggtgactcctctgcccttgcaggaacaatgtcctcttgctgtcccaggctctggctcccaatctgcctcctgctgcctgtgtctcttccccgctctggtcctcagtctcctcatttgtgaaatggagggttgtgctgaatgatctctaagcgtcttccaggctttgatgttatgtgattggtcttccctgggatgattattactggagtttggtggtggctgttactgttttactccctcccacttgcccagagatagatgagaaaagagaaggtcttataacatggtgagaagagcataaggcatttccaggttcaaatcccagcactgacagtttctggctgtgagatttcagacaagtcacttcactctctgagcctcagtttcctcatctctaaaatgggaagaacaatagtatctatgtagaagagtcacattgaggattaaaactggcaataagtctagactgttggggtgtatttgggtcttttggggtgtatttgggtgcaggaaactgaaagtcaaatgaaactggcatggacaataaagggcatttattggatagtgcaactgaaaagcccaggcagtgtgtagcaagggtagggaggggatcatgatgtcatcattgtgtcaaggatttactctgctttgtcctcctctgtgagccaatttttctcttgggctggctcccctcatgggagtcccaaaggctgcagcatttctaggcgtcacacatgcactctacgttatccagaagagaagggaactcccagcattcctggccaaagctcagaagtcaataaattggcttagcttgaatcacatgccccactcagcaagctctctagctgggggatgccatgtgctgactggcttatccctggggcagggggcagggtcagcttcctcagaaccacagggatccccacggagtggttgggaagggcccctgcatgctgggaatgatgcaatcaagcattgaggatcaccagcgactctagcgctgaggctctgaaagggctttccagacatctcctgtcccgagctatcattttacacaagggggacactgaggctaagagacgggctgatttcaggagggtgtcacttggaaaatgacgatcaagatctgccttggctgattgctgtaagaccccagtgagatgaaaataatgctttgagaaagaaggaaagaaaggaggaaggactcaaatagatcacagacctactaggtgctagattttctgtacctgtcatgtcatttaatcctcgtagccaccccgggaagcgggttttgccattactcccagtttacagaggggaaatgtgaggctgagagagctgaggtcacttgcctagggtcacaccctaggaagcagtgccaaagggctgcgaagctagttgtgtacgattctggtccaaggacacttgcatttagtgtgcacctactgtgtgctaggtgcttcccaggccaccatctcttatgtgagtgctcagtgggtctgcccatagcgggggatgtgttctcaggagagagcagggatcccttcttggccaccagaaatggtccatttttcaagttgtctttaccagtggagactctatgacttctttcttgttctttctgtaacctggtcccctccccaatcccgaacattttctggcctggcagctccactaagagtctcgaatcttccaggtacctgtacccagccctgggactggatgaggaggttcttctggagacacccaggcctttgtgtccctgggccccagggctccgtcccacccctggctgccccctcctgggcccctccccagcactggttttgtgccaatgtttgggctgctacagccctggccaggctcgaaaaaggaattatttctgtctcttgcatagttctcagcccaattcccaaaatgggaagtggcctgggagggccgcccaacccccactccagtggaggagggaggcgaggagaacttggcagagctgagacacacacacacacacacacacgcacacacacacacacacacagctccttctctaggcctgtggcctgtagagggaggccaggcacttcagagggagatgagggatggctcttggagtggggtgcctcttccctcctcttccagaatgctttccctgattgttgaggggctgtatcaggctcttgagaggggtrttgggacccccggttattctgtgagcttaggacccccatttcttaacattcctcatagcatccagtgtttgtctctgcccagcctggatgtctgtcataatggccagctgcatcactggccagaaggtaggttggttctgacggacactgactgactgacttgtccaccgcaagtctgagagcctgacagacaggatagctgactgactggatgaatggctgtgcctgcctgcctgcctgcctgcctgcctgcctccatgtctgactgaatgtccctctctgagacagagagactctctccctgtctacctggctgcggctcttgtacctgactaattagatgcaaaacaaattgcctttctctccatctcctcattcaaatgcctgttggagtgtctgtctgtctgtcttcctgggtgtttggctggctgtaattagatgagtaactaagactagctgtccatctcctgtctgactgactgactagctgtctctatagctgactgacaagatggctgatggacagcctgtctgtctgtctgtctgtctatgtctgtctgtctgcctgtctgtctgctgggtatctattgtatctgactaacagatgaagaagcctgtctgttcatctcctcctctgactgactgaccgtctgtctgtcagcctgcttgtctgactgcaggcctgatcaaatggctgagtgacggcctgcccatctgcctgtctctacgtctaactgacaagatgactgtcaggctgatcacctgtttcccacctcggtatccgaatgaccagctcactggatacttgactcttgactctcctaactagacacaactcccaggctgtcctagatggtcggaagggcatgggtgacacccatctggaagcccccacccagcctcagcaaccatgcctctcccctccctccagggctccctggcccagaggagcaaaagtcctttccctgccagagcagggagggggaactgagtggaaacctcaacgcctgcccatgtgttcatgtttcacatgtttgcactgcctggagatgggggtggagggtgagccctgtgttcctcatccatcctgcacccctgttttcaggggtcttaagggggaaacatccttccccaaagaggccacaaggactctcccaatatgtaaggccctacccaggccctgcaatcctggaaagcaccttggggaaccatttcaaactcttcacccctgtgttgctcagacactggggcagattcccagaacaggggccaggtctggggcagccagccaccggtgggagcacgggctccctggtcaacatcagcagacgtccaccacctccacctgtcaggaactccacagcccttcagaaggaagccaagctggggagagtgagtaacactttgccgggagggagggcacagtccttcctgctggctgcatttcctcctgataatagaattctgcccagctgctgggctggctgctgtctgacctcccttcttaamgacagaatttgctgatgaattttgtttcaggagaaatatgtgtgtgaatgggggaagagacgagacagagagaaataggaagagtttgggagcctctagatgaaaagcagcatctcgagaatttagctctgtctaaatcatgccttccctgtcttttttagagccctgtaggtcccccagatgggccccggggatgacaggctgggtgacctctgcacaggccagtggaatcactttaagctctggggaaaggtgggaagagggcattctgggagtctctgaatccctgggcagtagacagcagcaattggagatggctgggcatctgaggccagggctgaactcagtgtatgactagggttagagatcaatatgtgacaaagattatggttcaccctaggaccagattatggttgactctatggccaggatcagggatcagtcagtgaggagtgccaggactcagtgtctctccagggtcaaagctcagtctgtgtcctgcgtcagagctcaaccagtgagcagggtcaggactcagtgtgtgatgagggtcagggcttatccttgacaaggatcagggttcagtctgagactgaggtcagtacatgacctgggtcatagatcacactaggagttagtctgtgatcagagtcagggatcagtatgyaactagggttaaggatcagtgtgtgaccagggtcaaggcttakcctaggaccagggttatgaaggaatgtgcggccagggtcaagattcagtgtgacccgggttaggactcagtttgtggctcattcaggggctggagttagaatcaatctggacacttgggctctaggagtaacccagattcttatgcctgaaggacaggcagacgggggaccagcgtatacctggctggctcctgctccccctcgtcccctcttctacttgggytccaagggcaaaaccaggacactttaggagcccctgggacaggggaagattggagagtgtcctccaatccttgcatgttctgctgcagctggggccagagagggtcatcctcatgtctggggaggacagggagacagaggactggctctgataagcagggaagaggagaagaaagtcatgaaaggaagtagttataagtatggcatctgtagcagaatacctgggtttgaattctggttccgccacctactagctgtgtggccttcagcaagttactcaatctctctgtgccttgactttctcatctctagaatgagcataaaaatagtatccatagggttgtagtaaggattctaagtaagttaatacatgtaaagtatttacagtgtgcctgttggctgtatgtattccatcaattttagctgtttttgtttgctctgaagccatggaggggtccaaccttgtgaactgcccaggcttgaggatagagggctggagcccaggctccgatccctgggcaactccctagacctgcaagcctcccctctgttaggttccgatgccatcataatccccaactgttgtaacactaatgacatttgcagttacttctctgattcctgtgtccccccacctagagcacctgctcctgaggaccaatatttttatctttcttgctcactacgtatcttcagcacctagcaaagtacctggcacacagtaggtgctcaaragacagttaataaatgttttattactatgataataataaaagcaaccatttgcattgagccaaacactgctcgttgctttctctctcatttttttaatccagtcttttaaaaactgatcattaaaataaatgcattcagccggccacagtgactcacacctgtagtcccagcactttgggaagctgaggtgggtggatcatttgaggtcaggagtttgagaccagcctggccaacatgatgaaaccctgtctctactaaaaatacaaaaaaattagccaggtggcgcacacctgtaatcccagctactcgggaggctgggagaatagcttgaacccgggaggcagaggttacagtgagccgagatcgtgccactgcactccagcctgggcaacagagcaaaactccatctaaataaataaataaataaatgcattcaacagtaagactaattcaaataccagagggcatacaatggaaagacagaaatctcactcccacatctccaggctcagaagaagccattttcttgcacgtctttatattaggttgatgcaattgcttttgcaccaacctccatggaaataggagttttgttttatccacactgtattcctcctgcttactccagttcctggcaagcagtaggtgctcaataaggctatgtagaaagattatttttatttctaataccaatgggattatgtcatatatactgttgggtaccttactttttaactattaataaatgaataagccaccgggcgcggtggcttacacctgtaatcccagcactttgggaggccaagatggatggatcacgaagtcaagagattgaaaccatcctggccaacatggtgaaacccatctctactaaaaatacaaaaattagccaggcatggtggcrtgcgcctgtagtctcagctacttgggaggctgaggcaggagaatcacttgaacccgggaggcagaggttgcagtgggctgagattgcgccacttcattccagcctgggcaacagagcgagactccatctcaaaaaataaataaataaataagccttagagatctttccatatcagcaaaaactagatttacctcattcattttaatggctgcataatctttcatggcttagatgtaccatacattatttaactagactcttcgtggatatagtttttggttttgtttttcttcacccatcatgacaatactttatttaagtatcacacctcaactctacaagggttaactctgattttggctgagaagactgcatctcagagaatctaaagcacttgcctaaggtcagagaatctcagcacttgcctaaggtcactcagccaacctccaagcccattccaccacccaagctttttctttgctgcccgccaatgcccctcgctgagttgtcccatcgccagcctcagagaaggctgccctgcgacgcttctatcgcctgcacagggcattgccctcttgcaaggttcttctctaggcctttgtcagtgtctttccagagcctgaagcaggctcagaagggttaagaatcagctgggtgcggtagctcacatctgtaagcccagcatttgggaggccaaagtgggtagatcacttgaaccgaggagttcaagaccagcctggccaacgtggcaaaaccccgtctctacaaaaaataaaaacattagccaggcatggtggtacatgcctgtaatctcagctactcaggaggctgagacacgagaattgtttgaacccaggaggtggaggttgcagtgagctgagatcgcaccactgccctccagcccaggcagcagagcaagactctgtctcaaaaaaaaaaaaaaaaaaaacccaagagtccccagatgggcctagaatccacatctccagagctgtgttaagatagttctcagctggaggtgattttgacctccaggggacgcttgacaatgtctgggtcattttggttgtcatacccgggggcatctagtgggtggaggccagagatgctgctgaacatcccagaatgcacaaggcagccccctacctgagtgagccaacccaaaacgccartaggtcgaggttgagaaatgctcggtgaagggcacagattcttgcaccagacttcctggggccaaatcctggctgccgcttactggccgaatgacctcagacaagttgatcgatctctctgtgcccctgtttccttatctgtaaaatggggataagagtagcccctctcttccagattagatatgtaaatcactttggaaaatactcagtatctgaaaccataactggaatatttgtcctcagaatctggctgtcagagctgggagaagatgtaccctacagagaaaacagggcagcggactgctgccccaccatggcccagcctcccccagggaatgtgacctcagtccacagatagaagtagatgcccctgacgctgctgacctctgctcggtcaggaatagaggaaaaatcgctgtttccattttgaggtctgaaaagcagctcccaagataccctcagacttggggattttcaagaagcctaacattaaaggattttaggaaccagcaactccaagccatccatttgacaggtggaaagactgaggcccagagagagggtarggggcaggacttgctcacacagcaaggccatgacagacctgagctgggacgcrgcccaggacaaacacgggcctccccacagcccagcccaaaggctcttctcaggtacagaccagcgcctgggtcagattcgttcttccctcttttctgagagtctctggaatccaggctgcctgaaaagcaatgtcatgtgtttacaagcacagctttgacatcagacagaccctggtacaaatccccatctcaccagttgcctgtgatgactttgggcaggccatgtacaattctctgagcctcagcaaaatggacaccatctagtttgttgttgaaaggattagagacaacgtgtgggtacactcccacattgctggtggaatgcacgtcagccagacttctttgcagggaaatttgacaaaatctaagaacactgaaaaagcatctgcccttgcattcagcaattcttctgaagacaaaccctcacatgtgggatatgaacaatgtccctgttttgtctctgcagtattatctgtgatagcaagaagttgagaacgacccacaccaagagggacttggtggaacactctagggagcatctgtacaaggtcttagacacattcatttaaaagttcagggcagctctgtgtgtacctatttgtaacaaccttcaagatatattgttaagtgaagacgtaagatcctgaagggtaggtggagtatatgctaccgtttttgtggggaagaaagaacatagataaatacaaatgcttatttaggcacggtttcagttaagaaggcatgtagctgcaaggatgagaaaaatccaacagacgatggcttgagcaaacacagtaagtccagagccgggcagcgcagcactggtgcagctgctgaaggactcaagcatcgttctttcctttccccattctgagtacgtgtctctgatccttacggtctcaaggtggctgctcctccacctccaggtatcaagtccacattccaggcagaatatatatatatatttttaattgagatggagtctcacccaggcaagaaattttttttaagggcaaagggcaaaagcaaaacaaaaacacaaaagtcttcttttccgggcactttgacttttgagggagtgaaaagaaattccctgcccagggacttccacctacatctcgctgtacagaccaggtcacatggctgctgctaactgcaagggagtcaggaatgtgagtgtttttatctgggcatatggccacctgtgagcaaaattggggttctgttagcaaggaggaggtggaggctggatactgggtgggcaactagtaggttctgccattcctagtccgtcactggaaagatccctaagaaacaaaatagtagtcacttctgaggcagagagctggttgacaggggacaggggcgggaggaagatccccctttttaactgtgtacccttttgtacctttttgattttcaaactgtgtgcaggtactgcccttcaaaattaatataatttatataaaaagtgaaatttttaaaaactcaatgcaggctgagcacagtggctcacgcttgtaatcccagccctttgagacaccaaggcgagccaatcaccagaggctgagagttcaagaccagcctggccagcatggtgaaacccccgtctctactaaaaatacaaaaattagctgggtgtggtggcacatgcctgtaatcctagctacttgggaggctgaggcamgagaatcacttgaacctgggaggtggaggttgcagggagccgagatcacgccactgcactccagcccaggtgacagagtgagactgtgcctcaaaaaataaattaaataaaataaataaataaataaataaaagcacagtgcatacaaagatgcctggaatataacatgcactcaataaaactggctttccttcttttatcacctggcttagcatcaaatgcacattgaattctcagctctgctacacctaagttttgtgaccttgggcctggttctccagctgtctgtgctttcatttcctcctggatgcgttatgagatgcaggtcaagcatactgttttagtggctgtcaggagaattcctcccaggggcccacttttgttgaggagatggcttcttaagacctgttgaaatgggagagccccatcggatgtgggtggatggggccaatgtttcccagaaagggagctacctacccaacaccccttacgctagccacgtgataataacagaagccaggacggggcacggtggctctcacctgtaagcccagcactttgggagactgaagcgggaggattacttgaagccaggagttcaagaccagcctgggcaatatcacaagactctgtctctaaaaaaaaacaaaaacaaacaaacaaacaaaaacttaaaaattagtctggygtggtggtgcgttcctgtagtcccagctactcaggaggctgaggcgggaggatggattgggctcaggagttcaaggctgccgtgagctatgatcgcaccactgcactccagcctgggtgacagagcgagatcctgtctctaaaagaataacaatctgcagccataaaaaagaacgagattacatcctttgcagcaacatggatgcagctggaggccattatcccaagtgtattaatgcagaaacggaaacccaaataccacatgttctcacttataagtgagagctgaacattgggtacatacggacacaaagatgggaacgataagcactgggaagtccagaaaaggggaaggaggggagggagagggggaaaaggattgaaaaactacctgttgggtaccacgttcactgcttgggtgatgggatcgttagaagcccaaacctccgcatcacaaaatatacccgtgtaacaaacctgcacatgtaccccctgaatctaaaatgaaaataaataaataataggagtgaacattcattgagtgccaaccatgtgccaggcactgttctaagtgcttttacatacattaactcatctaacctggagaagaatcttacaaggtgtttactactattgactcttctgttaagtctgccagaatgataacatgtttgatgggttgagtttctcatggaaatcggtggcagaggctgagacagcatccagatggattcaggacatttgaacccaagggacagaagaagcaaggaccccggcatttatagcgttctggggaggggctgtgattgaccttggcgattgggaggcattcaaagactgttcatcaggtaggaagcttttgatctcagctgacatctgggtcaagttaaatggcaataaaaatccctgcaagtggaggttccatggatagaattgctagtccacaactagcatctgaccacttcacacctccgcctccaccccctggccgagcccccttcgtctctcacctggtctatttcagtagcctagtcactggtctcccagcttccatcctgcccacatccaccccacagtccattctccactcacagccagagagatttggtgcaaacctaagtcagagcatgtccctcttctgctcaaagccctccacggctcccacttcactcagaaccaagccatgggtctcggcagaacctccctggccctccagggtccagcccccatcagttctccctccttacctcttagcttcctctggctcagtgctcccaccccagggcctttgcacttgctatttctcctgttgcaaatactcttccacccaatttctgtgccccaccccacccaatctcttcattcaagtctctgttcaaaagctacctcctcagtgtgtcttccttggaccacagtgcctctcctccatctaaagcaactccagtcctggccaaccctaacccagcccgctttatttttcttaaagtcaaattgcgcttttcatatttcgagtcaaattgcacttgtatctgttcctctgtctcttcatggttagcttcctgagcaagcagagattttgtgctcttcacttggctcatattagatgccttacaaatgcattttattcaaatccatacacacatatacatataacagctttattgagatattattgagatgtacaatttacccattaaattaaagctacaatttacccccattaaagtgtacaattcgatggtttttagtacatacacagagtggtgcaaccatcatcataatcaatttcggaacatttttatcatcccaagaagraactcctaccccttagtagtcactctccatctctccccacctccatcccagccctgggcagccactaacctaattgttatctctctacattgccctattctggacacttcatgtaaatgaaatcacacaataagtgaccttttgtgtctggcttcttttgctcagcataatgttttcaagattttatatccatgttgcagcatgcgtcagtacttcattcctttttatggctgaataagcttccattatgtggatataccacattttgtttatccattcatcagctgatggacatttgagttgtttccactttgggctatcatgaataatgctgctatgaacatttgtgcacaaatttttatgtggacatatgtttttctttctcttggtatgtacctagaagtggaattgctggatcatatggtaattctatgtttaacctttagaggaactcccagactgttttccaaagtgattttgccattttacatttcctccagctatatatgagggttccagtccctctacatccttgccagcacttgttctgtcttttttattctagccatcctagtgggtgtgaagtggtatttcactgtgattttggcttgcatttccctgattgttatcatagtatttcttgacagagtggattgaatgacatgctgtcaggtgagagtccacacagcagtctgaatggctgagccccctccaccgccctccaggccaggaccaggctgaggtctagagcccaggtgatcgctaggaaggatgctctctgaggctgggcagcctcccaggtcaggccaggtggttggactaaccttctatgccatctggtggccagtagccagctgggtgtgaaaatccaaggtgggcaccaagttatggcaccttagccgagcctgggytgttgactggcagctgtggccagatttgcaggccgggctctaggaactgtgatatcgctgcactccctcaccagctcacagtgcctttgcagggtgtggcctcctttcatctgctcctcagcctttgcaagagctgctgttacctcttttttacaggtgaggaaagggagactcagagaggtggcttcctggccccaggacacacagcatccctgcccacctttccaagatttgtgtgtacattctacaaatacctattgagtgtctttgatgtgctgagccctgtgctaactctggggttccagagtgaataagacaaagtccctgtcctcgtggagtccacccttcggtctgggagacagatagcacacaagcagatagatatgcactataatatcaggaggggacaagggcagtgaagaaaagtaaagaagaaaaggaaggagctgagtaataggagggggcagagtttgcaaatttagataataaaaataataataatactcaatacttctgcagtgtttagtttggaggctatgctggccataagcacctccacttctgccaacacaaaaaccataggccaggagtaaaataaaggatcactctttctgggggaaggtggaggagggaggagagagaggatccagggcacagccccctggagagggatcgttaccaggtgccaagccgggcccagtgatccagcttccaccctggtggggacaggcctcatctgccatggtgggccctgtgttaggggaatgagagaatgaactagaacttcttaggcacctacaacatgccaggcactgtactaggtgaaggtggagttgggggaaatcaaacagcatcatcatcactgctgtcccctccccggccactgccacacccgtcctcccagctgcaagctaacaacaggctttgtcacgggtgtgcaaccagtgcagtagtaccagacgccmctctcagaagggccccacactttgttagaggctctgctgtcactgtcatgaaatccatagtttttgaacaagggtccccacattttcatctgcactgggtattgcaaaccccagtgtgtccagtcccagcagtaaaggaacaaggaggcccccaactccctccccttgctggagcccgtcataatggctgctttctttccgttggaatttaaaggcattatttgatccatctagtatactcaagtgccttgtgagttttctcagagggtcaagaaaagcatttgctctttagagaaaccagggagcccaggaagatgatgggtcagacccgagagaagggtctgacggtgcatttagcttggggagcccatagggagcattaccagggactccatccactgagattttcaaatacatcacccgcctaactcccaggatcccagagcctcctgaaaaggaggcaaacaccactttgtggccaaagctttttctaatattattttacttcatcctgcttgggaaggcatcaccattattagcccatttgcaaaggatgaaaccgagactccataaggcaatgctaattgcttagggccccgtggttagtgggaggaggggtggggagcagaaagtagggccatgtgatgaattttgtggcccccgggcacttaggcctctctccatgaaaaaaaaacaaacatgctatattatggctacattggtataaagatgaatatattaatatcacatacagtattacaacattttcttcctgctgaaagttctttttttcttctaattataaaagaaattaaaacattggagaaggggccctagaggtagtgtgaaccccaggctgtgtctattgggcctaatggagaagtcagccctggcaggaggagaggagaggaagagaaggaagatggagaggagggaaaggaggtagaggaagaagagaatgtctgtgtcgcttagcaaaggcgccaaggtctgcagtgaaatgccacaggcagcagctcaaagcgtggccctctgctcttaacccaagtgtctgaagtcttggtgccacctccctctgagacaccctctccctacccacccggccccttctctcccctcctacctacacctagtgaccctgggagcttcatctgccccagacatcacctgtctaaagcaggtccctgttagatcagatcggcccaagggccttgcgtgggatgtgtgtctgcggccacactctgccccgtcactccacctgcccccatgccactgcctgtcttcacagattggacgtgtccttcctgatttatactgtcatcctggcaggcatcaactggcatgcagccagcaacgccgttaccttttgctgccattaacgcagctatttactccacggaaaatgaccttaatttacaaggcattataactaatactggatgattacggttattaatatttatggattgacactcccaggaggggacctgggtgctaattggcactcctctctgtgcctcttttctcaatgagatttcttctgatttctgctgctgttccagctctcagcctcttagtttcaaaggaaaataccgcacggtgccctgccttatttctggctgattctcttatttcattcccttatttccttcaggttctgtaggtagcctagaaacaggcctgctgccctaggggctcctgggtattgggaaaggtctggggtcctggctgaggggaatttggctgtgaggagtagtaaggagagggagtctatgcttctactttagaggacgtggagagaagagaggcatcagggaatgtgtacatttgcccagaaacaaagcactgtctcagactcccacaccttcctccatcrctaatcaaaaatgttctggtctttttatataagatggaatctaaatcaacccctcccaacgcctcatctctgggttggttgaacaaatgggggtgtttggggcatctgcatttggggcccagattggagaagacagatcacactcccccttctcgctcttaggttttggggggtgccaggagctgatgttgcctgggctgagaagagagatgtacttgtcatctcctctccttttcaggtggaagatgtgttacaaacagcagcatgttgctatggtaaccaaggtgcttccttccaagagagagggagagtgtcctgcttgtggtccctgcatggcctcactactcacgcctgtgtcccatcagctgggctggggccaggcagccctgtacaagagtgatatagccaggagggcactgggatgaaatggggcacttgtatcctgacaaaaggagcagccactgcccaactcctgtaaatagctgccatgcagaaaaatgggcacaatgctgtcaaaccttctgattaccgaagagaagtgggaaatttggattaaggcacactgtcccaattatttttattgttggcaaagaatgcaaataataatttttttttaagaattaaacaaacatggrccaaacaaaacgtgtccatgaaccggccatttgggttgggcagtttggtagccattttgccatctgagcagagtacacactcacagaaggtggccccactcagcatccttctggggtcccaaggtaagtgaatccaggaagaaagctttctaaggagataagaggtgggaaacgcccaaattcaggaactcggaactgtgttcagctggaccgtgagtctctaaacaattgttcaggatccaccagctgctgttgatcacgggttaagaaaggggcacatgggttctggctgtgtctgaccccctttctgagtgaccttgaaccattttctccccttttgtgtgtcttagtctccccatctgtacaatgataggactgaaccaaatgttttcttggggtttcctcatgttgactgatatcctcctatacttattccagagtcattgcccccaacattcactctgtgtgactcccaggaattttcaaagttggggcttcagcctccagagagggtttctccccattttagtccctcattctttgacaacaatgtgttgaacaactatggtaatgggcatcaaatgggaatggggatggagaagtgaatgggtcaggtgaggtccctgaccatatggggctcacatcgactagaagaggcagaaaagagggaagggctgcgtttttgctcatccacgtggccagctggttattacctggatttattaaccagtgtccatctttcaagackcagttgagctgttacatcatccaggaaagctttcttaagcaattcccctaygcctttctactgtgtgccccatgactcaggattttgttctaactggtctaaagcaggcactattgacatctgaataattatctctcatggggtctgtactgtgcactgtaggatgcctagcaacatccctggcctctacccacaagatgccagtagcaatgcccccaaaacacacacataattatgccactgaaaatgtttctaaacgtcccctggggtgcaaaatcagggccagttgcaaacagctgatctgagacaatcatggtggccccattccttttgctcgtgatggtctgagtatgaatgtgggcatgtcttcacctgatggccagagcagaggcagctatcttgtgtccatgaagtaagccagcctgggaatgaagccagtcctctgagggtggtagagtagatggtagagagtctggatatttaactatgttgtcaagtccctcagtgatggggtaaccctatttcaggacttttggttatgtgggatcataaccctaactgctggagcctcttttggttagcattttctacttcttaaaccaagagcattcctaactgataaatcataaatcatacttcagatctcatcttaaatgtcaactttctcagaaaagcctccyccatctcccaatggaaattaggcatctttatcattctggactttgttttggtagcattcatcccaatttatgcttacattttgtgtgtctattgaggcctatcttccttcagtggactgtgagctccatgaggagaagaacctcattttgtcttttcttccactgtatccattggccaacatggtgcctggcatatagtcggcttttggtaaatatttattgaattaatgaatgaataaaggaaatgggaaaataaatgaatgggtagatagatgagtagatgaatatatgatttaatggatgcatgagtggatggatgaatgagtggatgaatggatggattagtaggtggatggatgggcaattggatgtgtagatgagtggdtggatggatggataaatggatgggtggatgagtggatggatggatgatggatggatggatggatggatggatggatggatgagtaaatggattgatgggtgaatgaatggatggatggatggagatataaaagggtgtgtgtttgcatctctgcctgtacgctttgatggaaaattctctgcaagtctacaaactccaaagttgaacctaaagcatcagaagtaaaggaagggccccacaaaagcaccttatttagtgctgaagaagaaagcctgtgaaatcacatcatctgccttgaacccaatggcaggcaacatcagggttttttgagaagtggcacagcgtgccaagcactggaaggacagagtggagaaaaacagcatagatgtggactaggatccctgggcaggtgaggcactgagaaaagatgtttggctttgttcacatgaaatctgatgaaatgtgaagcaccattatatcagaggcaggtggtgatgctctggctgaagcccccaccaggacaatgaaggagtaagctgggatttaatggaacagatggggaaactaaggcccacagtgtcaaggaacttgcttgggttccctcggaaagtggcctcaggccttactctgggtgtgtcccacgcactatgatgtagctgagagagccaaaagctgtrtgaccccagacaagtcattttatctctgtgagcttccatttcttcacctggataacaagggtgatggtactacctcacattcagcaaggttgttgcatggcttcagtgagatatcacaagcagagcaccagggcactgagtggtgcccagttatcatgagttcattttcttgtctgtggttgggatatctgggagagttacctggaggaggtatcctacagattctcaactccataggaacaagccctcaggtgaatccttggagctgggggttgaaatactttcttgaaattcttcctgggacatccaagaagacagcatggagctgtccatgctggggacccttcctcatttgtatgttcccccttctaaaactcccttgccatggaaatgctcctcttggtattttttttaagggtttgattggggtataattcaaatgccataaaattcacccatttaaaatrtataattcaatagtttttagcatattcaaaaagttgtgaagccatcatcacatctaattttagaacattctaatcaccccaaaaagaaaccctgtacccattaacagtcaccccccattccttcctcccctcatctcctggcaaccagtaatctatactttctgtctcgttaggtstacctattctggacatttctcataaatggaatcatacaatatggggccttttgtgactaacttctttcacttagcaaaatgttttcaaggctcgcccacagtgcagcttgtatccgtttttgttcctttttatggatgaatactactttattgtatggataggccacaytttatttatctttcatcagttgatgaacatttggggtgtctctactttttggttattatgaataaagctgctatgaatgtataattttttgcacagacataggttttcaattctcttggatgtatacctagaagtggacttgctaggtcatatggtaactcttttgaacatttttgaggacctgctttcttgttcccctcactccaaatgttgtagtataattaaagtcagagttgtccttgtagaccaaggcttttacctcccagctggacatttccaaggtctcttcctctaccaaaatttaagtgatgccccagcctgcatcaagatgacatggattcaaattcagtctctacctaggctgtgtgatctcggataggcaactaagcctctcttaacttccatttcctcacctgcaaaataaggacaaaagcaattcttggctacaaagacaatcatgacgttgaaatgagggaatgtgtgagagaattctttgtgaaagctgaaaacagcagtagagatgttgttcattcatccaatgtatatcaagggcctattatttgccatgtactatgttttgtgatgggacacgatgttgaccaagacagataaggtacrtgccctctgagattttatgttctggtctttttggtcatagattgccaccaaatgttctataaacctgaacaaactatgcttcctcttcaggcctcagttttaccatctgtaaaatgggtgggctggatccacccatttgccatagaatttctacttctgctttcagcccaacagtaaaatgagcacaagtgtctcatacaatgcagacttctaaattctgtccctcaggggatagcaagggtgggctcttcctagctgctcaggatagtcgaaggggacagatcaaaaaaggcagtccgtctgggatagccatgtggacgggaatgagctaccttccccctcacctccacgtcttctggaacttaatgataacatcatccccacgcagctcctggcctaattggcatgattccattacatctgctggttctttcccataacggaacccagcctggtggtccagacccgactgctgggccacagctgagaaaagggccccccgggagtgtgtgttcctcacgaagaacaaagatgtaggcagcagcctaaaatagacacggaaaaacactgctttttgttttctccctggaagggtggctgagtgattcgcggcagggaacccagaaggtctgcattgaaaacactgttattataagacagtcaggagggactggaagctgcgggtgctgagggaagacaccctctctcaccactgcatgcactctgggctggagttggatcccaggagaaccctgaaccagacytaatatccagaataatcctcactcccactgccccacaccattgccaactctggcaggtcctttcccatggctccctgttacccttaggataaagtcaaagtgacttagcaaggcattcaaagctccccaggttctggctttaagtgagtttactggcctcttcccactgcaggttattcattggaaatcccagaacttgttctgcattttcctgcttctgggcctttgcttacccaacaccttcacctaccatgcctggatgaatccagaatcttgattctaactgatcgtagcaaaaaaagaggaaggcagaagggactgattggcttatgtaactgaaaagcccaggggtacacgccttcaggctcagctgaatcaagktgctcaaattatgttctaaggtttctgttttcctccatcacctggaccttttttcctttgtgttggcatcctckcaggcagctccccaagtcatagcaaaaatggctctcagcagccccaggcttgtatctaaccagcccagcagctccagtgggtaccagtagttcctaagagctctgtggttgacatgcattggcctggattgcatcatatggccatctctgagccaaccactgtggtcatgaaccacatgcccatacctggagccatttcctggggatcagaagagggatggtgccagggaaaaatcagggagctgttacagataaagagcaagtagatactgggcagttaaaagcaagtgttcacaacaatgcccatagctctggcccacactcagccaattccaactttaagcaaatttcaccgggaaacaaatacctgggggaagaatggttagaaactcttctgggcaagactcatcctctggtcttggtttactcacccgagaacaaaaaaggttagacttgaagctttgtccgaggtctttcctgctttgacatcaagtgaattgcagcaaaacagcccttccttgtctcccaaatttctgatcgaagagacctagtgagtcagatcaaggaatggactgtcattaaaggccagaaaaagctcttttttaagtttccacttattgtgttctatttcctaggctctgtgttaagcatttttccaggtacattgttttgttcagttcgcacattaactctctgagattccatactacatgtgaggaaactgaagctgtgaacactgaagtgagtgaggattgcagccccatcggcctgactcttaaccactatgccacactctttccatcccaaaccaaagacccttagagacctcggattagagacttgggctgcaagcccaaagactcccataggtagaacatggccacataaatgaatgaagaggtccacatagggcctttggcactggaatgctcatgcctcagccagttgcttttacagatgcagaatgcacagcttaatatttttctttgttttcttttcttttctttttttttttttttttttttttgagacagggtctcactctgtctcccaggatggagtgcagtagcatgatcatggctcactgcagcttcaacctcccagcctcaagtgatcctcccacctcagccttccaagtagctgggactacaggtacatgcccccacacacagctaatttttgtattttttgtagagacgaggttttgtcctgttggccaggctggtctcaaactccttgggctcaagtgatccaccctcytcagcctctcagagtgctaggattacaggcatgagccaccacacccaaccttagtttttcgagataaattgaaaatttgcattctaaaacaaaatctctcaactttataactgttagcaacttgctcagttcttgaaacactatgtaaaccaaacaaaacaggtctgtgagttagattcaacttacaggccaccaattttcagcttgtctctctttgcttcgtacggatgggggaaactaagtcacagatatatgtcatattatacatatatatwtatatatatatatatatatttggccttatcactgaggctgaattaggtgctttctcctagggtggtcttggtagtgtgtctctgagaaggtgacatatgagcagaaacctaaagggagagcttcccttctgggggaagagctttccaggcagatggaggagcaagtgcaaaggctctgaggcagaaaagcaactgtatgtttgaggaacagcagtaagactagtgagctagagtagaataagagagggggagtgaaaggggatgaggacgggataaccaaatccacttctacatagggcctgtaggacccaggttctaattaaaatgaacaactgagaggacaaggtgatgaatggatttatgaatgaatgaatggattccaagctgctttcatgggatattcgtatttggtgttagtgtgtgggtgtggctgattcgccctaggttctgaagtcttcagaattatcctggaagatgatcttggttaccttcccaagttgctgtcagtcttcagaggttgtgacacttggatagaagcctcaaattgggcagggcctctgggagagcaactatgagacagacaaaccaagaagaaccaaggcaggaagagatggtgctcaccaaaatacccatcacgccaagtgtgctcattcccaccagccagggaccccaggcttccatagagtactgtgacctggacagtgagcccatgaatctcccttgtcaccaagtcctcacatccctcccatcaatccctggcaaacccattggggatgccgtgcagggggcctgctcctgtcctcggccgcactcagcctgtgagactattttgtgccttggttcaggcactggcatcccagctgctggcaagcgactcagatggcgttgtcatggcgaccctcaggcacggatttccagagatgctccctgcatcctccygagcctgccactgctgattgctgggggagagcatgactcaccgttaaatatatcacrgtcgtcccaaattggctgctcagccccagcagccggatgtagggacaggcagcatctgggggtgtgtgggtttgggaagctgagaggcatgaccttctgtgtacctttggggccttcagctcctgtcatttccagcggttctcttctccaatcccctactcatctctccttcctttcccaatcggtctgggtaacagtcctagctttgttacttgttagctgtgtgatcttgaacaagaagcttcaattctctgggcctcaaagtcctcatctgtaaaacaggggtgatgtgagtatgacggaagaactacgaagggtccgagattttgcactgctcacaagctaatgagttagcctgccacaatgccatacatgacggcagaagacacgagatcccaggtcagagacaaaggactttattagtcacagtatagcargcagcacaagcttcatatttgcgtcagttctaattgtctcccaagttccatgagagcaatgaaaacaacccaaatggattctgcacacacagcagcagatctgtgtctcaatggaggatcccagagcttaggaaacctgcaatcttataaaggggctattgccaaacctgtctagcctttgcctcagatagagacattattgtactggttgggaaacaactctatcctcttctttctgctccagagagagatattgtctctgtcctccaagtgtgtttgctacacagatgtccttgagatgatagtctagaacaaaggtctcagtgtcttttgagctgaagacatgcagaccttggagagacccatggagaattatctcccaataccacttcaaagggcttcttggaggagcagatgggttcatacctgtaacatgctctgtatagttgcctggcatgtgcctggcacttaatcagtgttagcacttgtcattattactctcagcttttatcacttgtcagctagtaggaactcagaggcctcctgttctgggatttccccagttaggtgactaagaaaatcacagcttctatcctttccagccagtacatatccatttatctcctatgccccatgaagctctaacaactccaccctccaccccttgtcccctccctctgactcccctctgttctttttttttttttaaatagctttataccataaaaaattttaaacagccttatggaactttataccataaaattcattcattttaagtgtgcaattcaataatttttagtaaatttacagcattgtgcagccatcactacaatccaatttcagaacatttccaaaagaaaccccatgccaatttgcattcactccccacacccctttcacccaggcccaggcaaccaccaagctgctttctttctctatggatttgtctctttgggacatttcacgtaaatggcatcatacagtgtgtggccttttgcatctggctgccttcactcagtatcatggttttgaggtccgtccatggtgtggcatgcatcagtagctcactccattttattgctgagtagtattcctttgtacaggcataccatagtttttgtccagtcaccttcactggattcctgaaaggatattccaagatcatgagaataaaagctcttgtgcaccatcaagtgtagagcagacattgactgctattgcccacatcaccccttggagcttgtcctgccatcctggccccttggggtgttctagctaacataaaataagacagatrgatactttggcaggcagagttttagagacttttaaaatcacatgacaaacccacttcgatgaaaagcaagcaaagaaccagtccaaaccctactccaacaaaaagaggcattcacagtttttttttaagagaggggatctcaggctgggcgcggtggctcacacctgtaatcccagtactttgggaggccaaggtgggcggatcatttgaagtcaagagtttgagactagcctgacgaacacggtaaaaccccatctctactgaaaatacaaaaattagccaggcatggtgtcatgcacctgtaatcccagctactcgggaggctgaggcaagagaatcacttgaacctgggaggcagaggttgcagtgagctgagatcgcaccactgcactccagcccgagcaacatggtgagactccatctcaaaaaaaaaaaaaaaaagagatggggtctcattctcttacccaggctggagtgcagtggtgcaaccagagctcacagcacacttgatctcctgagctcaagcacccctcccacctcagcctcccgaatagctgggactacaggcatgcgccactgcacccagcttcacaaagattttgtaggctgaacttcccctgtctcttcccagctccatctccatggcagccccacacaataaataaaacaggaaaggaatagaaggagaggtttctgatgcttgcctatagagcggccttatttcctttgatagtccaagtaggacgatagccaccagrtaattccacattctgtgaaaaatatataagatcctgaattaagggaaaacatttgttctccacttttgccacctccaccctggccatagwggatcccgaggtgtgtttgattagcagaggattctatctcaaatagggaagactcctagactgttctcagctattctcattgacaaggctagggagtgccagagggaagtcagcagatgatgtttcctgacctgatttattggtcttccttaaaataaccccaggcctctctgttattattaaaatcctacatctggattgggttcctgcagggcccaggaaattccttcccagttgggaagatgttctatttctctacagccacataacacaccaccctccaaaacttagtggcttaaaacaaaacatttatttgctcgtgaatctgcagtgtgggccaggatggacaggcctggttcatttctgctctgcacacagcctccaccggggcggctcaactggggctcacttgctcgcagggctggaaagatgttgctgtctgacagttcccctccatgaggtggcttgagtttcctcacaggaggcatctggttccaagagtgatcataccaaygagcaggaagtgaaagataccagtttctcaaggtctgggtcctgaaactggcactgggtcatttctgccatattctactgaacaagcagttgcagagcccaaactcaaagggaagagacaaaagccttgtctcttgatggaggaatggcagagaatgtggggattatgttttgagactcacatggttggcaagtccatggcatgtcagtaggccagaaggttttggaagaaaatgctctgcaggactgttacaccataagtgctcatcccagaacaagatatttcttagaacttcacattggccaaagttggtttcggccaaatgtcacgtggcctagcaggccaaatgtgaagtggttccccagcttgtctgttctctgtcctcaggccagtgtccctaccccccacctccttgaagggctgtgcaggaaatccagaccttcttgcccagccttggccacgtgttttctccgaactggggagacccacaggtgagtcagcaggacatcatgcacatggtggcctgggtcccgagaacatctgctttaatggagtccagagaatgtttccaaacacgtcttccctctcctctcaccaaagcttttaggagaaaatgtccagagctctctggatgtcttccaggaacacattgacaatgagttgtaacctcaccctgaactcatggtgctgcatgactggccacctttgttgtttggaagacctagaatccttgtttttctcaggccctgatcagcagggctgtgcttatctgcatggttgtcttaacaacaaatcaccagtgccagtgtcctctgaggatcttttcttggcttcatggtgagaagaccagagtttgagggctgacttttcctcttagtggtgagagacattgggcaaggtattttacttctcttagccttggtttccttttctggcaggaaagtttggagctcacagtttccttcaagctccacatagttctcatggtgtttgtttgactaccttgaggaaacagagtgtaccttgccttcaaccacaaaaatacactgactaatgagtattgttgctacagccacctggacatgtggccataaactgcccaacccatggtgtaatgctgggtttgcctttcatggagagagagattcatgagacatttcagaggactctctgttgtcccggagtcctgaggagtctgcctggagacctggaactcatttgtttgttctttaatttgtgtctactgtatgccagccccttgctaggcatgaaggacacaacaatacaatcaagaaaaagaacaaagacctgtggctcttaaagcttgcattctagaagcaaaaggagaacactaaagaaataagagacaaatatataatatcactgcatatatgcaaaatgtcaggagtaaggggactggtattcatggggtgtgggtgccatttgaaatagagtggtcagggagagccrttctggggatgtgagatttaagcagagacctgaaagacacaaagaaaggaaacaggcctatatatggggctggagtgttctaggcagagggcacagcaagtgcaaaggccctgaggccagaccatgcctgttgtgctccaggaacagaggggaggccagcatggctggaggggagtgagcaaggggaggagtaaaggggatcaggccagagagatacggaggggccaggccctgcasagccttgtgggctgttctaaggactttggctgttgtcctcagtatgctgggagatagggaggtgttttgagcaaagaaaagtgccctggtctggcttaggttctaacaggatccgtatggatgaatctggagaatggactgtgttttattgtacgggccaggatggaagcagaaagacagtgaggaggcaactacaatcattcaggtagaagaggatgtggcctggcccagggcagatctctgggggtggtgagaggtgggcatgttccaggtgcctcctgcaggcagatctggaaggtcttgctgatgtggtagatattctgagactccctgtagctggtggctcagcgagcctcccccatcaccagcctcagcaggacagtctagactagagtcatccgcctctgccctgcactctgcctgcctggtgatgaggggcctctcccatccatgccgtgggcactgaggcaccgagctaggcccacccctggcttccccaggtggtgaatcagagggagctctggattggagacttttactctatgcatgacactccttagctctgtgaccttagacaagttccttccccactcggaacctcagctttcttgtctgtaaagtgggaataatgaaaccaacactgctacctcctagggtggctgggagaatcaagtgagatacaggctggacacagggtttgaagccagcgcagggggatggtcatgaatgagttaagcgtgtgtacattattaatagtatcatttcatcctttctaccatctcatgggctgttgggaaactttaacgtygattcagatcaggccatggctacactaagtcaacatctctcactttgatttagtggctaaaaagcctgggctctggaattgttcagaactgggtagcactcctagctcggcgctgtgagatgctgtttccagaggagasagcttaaaaaccacagacattcccctccagtccgcagcaagaccagcttcacagggtgggaattttctcttgcccatgttcagcagatctacatccccaggggtaggcctggccctgcctctgtgccttggtcagcctgtccccatcccctgggagcacctaaattgggactgtgggctgctgttcctcctgagaactcgggtttactgtccctgttctcgggcctcccttgtctctytcactccctaaggagaattgggacagggtccctccagcggagagaagcctggaagacttctatttttttgagactcctggaatattaatttataaagaaaacaacaacaaaatgaagacatccctaaagttgcagtacatttaagatgtaacattgagcaaatcgtgacaacctgcataaaatcacaacataatataaatgtgtaactcacataactcacaagataaccccaggatttattcgatttgtttatatattcgtattttaaacccatggcattctctaggagtggttcagtaagggatgcaggggtagtgttgtttgaggaatgcagtcttttttcgttgttatcattctgtccctgtttgtgtacmtaacccatttaragataaggtcaaaattctaaaaatactggaatgtcagttttctgaatagctactatatttccctagtatgaaagtcaaagtgttcaaaagggcacacagtgaaaagttctctcccaccctgtcccccagccaccccgtcctcctccccaggggcagccactgttaccaatttcctgtgatcgcttccacaaataacatatccatatataagtgaatgcatatatgtacatattcttttttccttgttttattgaaatgggagtttgttatacattctgttctcgcggtgctttgcttgctaacagcatacctcggggactgttccctatttatgcatattgagccatctctgttctttttacagctgcatagtgttcatatttacagctgcatataaatgaccctctgttgagttaatttttccctgttgatggacattgaggttgtttccaaactttttgatcgaataaacaatgctgcagtgaataatcttatacctatatcatgaaaactcttgtttaagatccttagaagccaggcgcctgggtcctgcccatagtyacatctactcaggaggctgaggcgggaggttcccttgagcccagcagttcgaggctgcagtgagctatgattgtgctactgcactccagcctgggtgatggagtgagatcctgcctytaaaataacaataataaaataaaataaagatccttagggattgtgaggtctgcaaggaatggcactcccttttgcccacaccaaccccttcctgggagctgaggcttgaatgaggagggcagtcccagagtgggggaagagcattccaggcagagggagctatagtgcaaaggcctggggtagaaatgagctcaatctatgggagaacagcaagaaggccaytgtggctgcatgggaccatgtgagagaagggtagtaggagatgaggttgagaggactttgggggacaggtgagatttggtgagatgggagggaatgaatgartgaagcctccaatacgataagcgaaaaaacatgatattccaagagataggcgtggtcctcccccaaattttggttgctgggaagactggcagtccctccccagctggatccmctaggccttttgccagcatcacctacagagaggaaagagccgtgggctctgtcacaaggctggggctcacagcatcacagcccccaccccctgcaccaccccaatagcttccttcagtggacttagctatggcctctcccaatacccacgctggcctgggccaatcacatttcaggtggatgggaactcgcgggaccaccacttcagccaccttgggctctttgccgtatttatattctcaaggcgtctgctgcttcccttattcttccccctgtccttacatggccagacccactgttcagctcacaggtcaccttctcaggccactgaatatcaagttgcatccccaccttctttctcccaccacctacccagcctgtcccatcccctcaatgtttggagccaccgtgaagggcgatggttaacagcttgagttccaaagccaggctgctcaagtggaacccaggagaagctgtgagcaacctactttccagctcatcccctcatgaggtggargtgatagagcttccacctctcagaccggagcragattcaacaggtaaatacacacaagccattctgaacggtgccrggcagatggtcctcaaaaagcttagtcctttgcctttccacctggtgctgatccctgtcttaaatgatctgtcttgttttttagtagagacagcgtctcactgtgttgcccaggctggagtgcagtgacacaatcatagctcactgcaacctcaaacttctgggcccaagtgatcctcctgtctcagcctgccaagtagctaggactaccggtgtgtgccaccacacctaagtgtgttttgttttgttttgttttgtttttagaaatgggggtctcactatgttccccaggctggtcttgaacttatggcctcaaacaatcctcctgccttggcctcccaatgtgctgggattacaggtgtgagccactgtgcccggctgatctatccttttatgcgtttatgtatgtgttgtctgtctcccctctgaaccatgagcacaggaagcatgtattatcatttgggttcagctctatgccccaagtgacatttaaacaggccttcaaggaagagctggagttagcccaggcaagaggagtagggagagaacacagcccatgtgagacctctgggatcggaatggtgtgggaagcagggagctgcatggcaataggggtgccgttagtaggactcagatcccgtagggccttcaaacctcagtgagaagtgtggatttattctgaaggcactggggagccatagaagactctaaagcagaggagcgacaagattagatcttatagaaagatccttgggattctctggaaggaggagtcagaggagacaagagtgagagcaaaaccacatcgaaacattattgcctttctagagtcagacagactttctccctctgctcgtgctctccctccgcccctctccatgaacaaaaccgtaactcattttctccctctggctggccctggcatccttcctctaataccactcattattttaattaaactctgggatctgttttactaacctgacatcttgcttaggaaaaccaaaagaggagttgcccggagccaaggaagggaagttgccagaggatcgaggaaaggtttccatctgccctgtggcaggagggggcccctcttacccaggtccagcacttaaaggggcagccatgcaccatgcttaaggatatgagcactgcggtggcctctgagctccatcacttactggggagagtgacgcaacctctgaagctgcttcctcatctataaaatggggatattaatagttcttctcttatagggttttgtgaggtttaaatgagttaacacagtgcttttcaaactgatggtcataaaatcaatctaagggatcacaaccaccactgaaaacccaagaacagaaagtatcagagtacattatcatcatggggatacgtcttgtgggtggagcgtttatttcagggtatgtgtactcgccgggtttttttttagaactatatttattactctggtccccagtccagaaggcttgaaagctacarttaaagtacttaggcaagtgcatgcagcaggtgctcaaactgtggttgctgatatttcttgtggtagcaagaagattttcytttttatttccctgcaatgtcattgggttttgctccatcttactcatggggagactgaggctcacagagagaagaagccattccaaagctacatgaccacactgagctgtgaactgtggcctgaccctgcctgaatatggcctgaactcccatccagaatcttcgtgaggtcgagggagggtcatgtggctgccaatggcataatgagagctcccggcagccagggtctrgcaggatgcaggaaagaggctggtaggggcatctggggctgggccacccttggctgtggccctggaggcagcacaaacccctaccctggagatctctcctctccacacccmcacctgcccacagcccataccccacagttaccaagggaaacaggcgccagaggggaaaggctgcatttccctccttccttgtgggctttccagaaaccaacccatctagaagagctctccacgtggagcaggggaagatgagcggctgaagtagggcagatctgcaaacttcgggggctttcaggaagattccatgaggcaaggactgggaaccagtgcctgcctgagaggctgaggggcagaagatctgggtcccagccttggttctgctctggcagggctatgtgcctggggccccgttccttccctttccttctggacctcagcttccacatctgtacagtgggtgtggtagctcccatgatcttcaggggccacaccactcagatgtctcraaaatgctcccgttgagtgtgtttctagttatgagaggtcgcttcaacatccccactagggaaggtattgtgtattcattcatccagcaaacatttactgagtacctactgtgtaacaggcagctagtgttgcacagggatcaagacagacatagttcctgtcctctcagggaaacttcattctagtgaatgagacaattaccaagtcaagaaggaaatgatgagtgcttccaaaaccctgaaagagggtcatgagataatagatgaggataaagtggctagggtggccagggaggtccctctggggataacggatgagctgaacgctgaaagataagaaagacctgcagagatctaggagaggagcattcctggcaggaactgtaagtgcaaaggccctgaggctggacccagtctgggayattggaggagcagcagggccagtggctgcagcaggtttagctcagctggtggatgtgagtggagagaggtagccggggccagatcagacagggtcttgaaggctgtgtgaggcgctggctttcattccaggtgcactgggactccactgggggcttttgaggagggcagtggcaggatcaatgcatgctttaaaaagagtgttctgattggaaaacagactgcgggggtgagggaggacatagggacagcacagggacagcagtgaggaggccactgtaacagtcctggtaggatacatcaggggcctggcccagggtgatgatcggggaggcaggagaagtgctcagactactttgaaggtggaacccatgggatttgcmgatgaacagaaaggagtcgaggagggctcttgggtcacagcctgaagatctgggaggatggaggcaccatttgccaaaaaaggcaaaacatagtacagagcaggtagtgggggatcaagagctctttggccttgttaagtttgagaagcccaagcgacatccaagtgtcaaaacaatcttcctcccacccagcaaggcccgagagcccagatagaggktggaggggagcctgcccggggtggagattaatgcacataacccagttctctctgcccgtggctatttgggtcacttggactgcaggtcctcacccctctgagcctgtcaatcacccccaccccaccctgtccctgtccttttcagtctctggaacctgctgccaggagaatgctcagggagggaaatgctcagggaggcacacctctctcactggctcctcgatgaaccctaaatttccctgcccctttgcctttgctcttaccgtaccctctgcccagaattccctttctcctcttccaatctcacacatccaaattcttttcatccttttatgtcaagcccagaagcctccaagaaacttccccagttcccacgtagactaataagaagagtattttgaatgcctgctgtgtgccaggctctctaaaaagtgctctacctttctgatctcatcgaatcttcagaggcagagattatcatctccattgtattcatgagaaagttaaggttcaaaggggtaaaaagtcactatcttgaggtcatatgagcaaagtggcagagtggaatttgaactctatgatttctgttatgtttcataaagcaacttaggtgcttactctgctgaaggggctctgggcttcttgaggggatagattgagtttatttagtttttgcatccccagaatctgccacaggctctccataaatgcttgccgaadggatggatggatggatggatggatggatggatggatggatggatagataacagatgaacaaatggacagattactgaacatatagatggtgcataagtagacagatagatagatagagtaggaaaagagagataagagaggtatgagagagagaatttctagctggtggaagagggaaagagcaagtgccaggcgcacgcttctatgcctgtggacacgtaaggccccaggcatctgctcacttctaccatatccattggccatgcctagctgtaagggaggctgggaaacagtctctattctgggcagtatgtttcccaatgcacatcagtggatctataacactaagaaaaggagaggttggataacagggacatattctgccccacttaatatcccatctcagtattttttttccttcatagcacttatcacaatctgctattaccttgtttatttgtttattgtctgactcccctactagaaagtaagcttcattgtggtaaggaatcttgactatcatgttcaccactatatcgccaacagtacaaatgaatgaaaattaattaacttattaattaaggcagcttgagctttttccttccacactaaattttttcagagttttcttttgtcaacatgtaattgcaccctgggggagatgtcagacatgtggctgtcatcatgaatgcagcagtgccgagagagtggcaagtccctattctacaaaaacacagtttagctgaatgtcacttagggaatgtcatgtcaaaataatgtaataaaaataccaaacatgaataagacggaggagaatgttgggagcgtgaagtcctcagcgggcctgcagcagtcagacctaattactcaggcaggctcacccctaccagatagggtcagygcaggaaaggggactgcaaagcgtgcccggggctgcagctcaggtggccaatggccctagaagccccctccaccctctaagctcaaaagactgtctttcctgcctgaccagcccagcctttcccacctaggctcatatgaaggcagagattctggttttaagagataaggtcactggttctgaaatgtggtgtatctgtggcctgtgtggcttccacgagacagtgtactgtggttaataacaggggctctgagcccagctctgcctgagttcaaatctcacagttatctcttgcaacagagaccaaatggtgcacaaagactaaaatatctactatttctgctgtggaaccttgcccgaggattccagtctctctgagactccgtttcttcatctgaacatagggctgcctatctcatcagggtcctatgagctaagacatgtaaagcctctggagcgggggccagcaatccagggcctgtgggccacatctagcccaccccctgttttggtacagccctcaagctaagaacagtttttacattttcaagtggctgaaaaacatccaaagaaaaatattgtttcgtgacatgtgaaaaccatataaaatttaaattttaggaccatcagggtttttggaacagagccataactcacaaactcatttctgtttatctgtggccgcgtctgtgctgccctgcagagttkaagggttgtgacagagatcatgcggcccccaaagcctaaaatatttactctctracccttttacagacaaagtttgctgagccctggtttagagagcattgccttattcaggcccttagggaagcaagtgtggagygggccccaggctgcatctattaagcaccaactgtgggcaacctcttgggttaggcacattatatttgtcatccctttcacaatactctgaggtcagtgtgactgtccccaccttataaatgaagaaactgagactcagccagscacggtggctcacgcctataatcccagcactttggcaggccaaggcaggtggatcacctgaggtcaggagttccagaccagcctggcraayatagtgaaaccccatctctactaaaaacacaaaaattagccaggcatggtggcaggcacttgtaatcccagctattcaggaggctgaggcaggagaatggtgtgaacccaggaggtggaggttgcagtgagccaagctcacaccaytgcactccagcttgggtgacagaacaagactctgtctccaaaaaaaaaaaaagaaagaaactgaggctctaagargtggtggaagctcctcaccctggccttcaaagctctgcctgattwgcccacagtcgcccagctgggtaagtgttaaagctgagatgtgaacccagggccttctgattccactgagccccctgcttctccccctcacacatactgcgtgccctgttgcctgaagtagctctggaaacatgccagcagctatgtctctccaatgcyggacagaggaatcacgtggaagtgtttgtaaagatgtgaactcctgggtcctagcacagrycacctgaatcattatctctgtggaagaccctgggatcttcattgmcagcaaactaccccagtggatttcaacaccaggagagtggttgggaggaggagggccccataggctctagctgccagggaaggtttcctgaggaagagtgggcaaatcagggagaggagaggccaccccaggcaggggatcctgtctgagcaaaggtagggaggcaggaatgaggctgctgtgtgcagcgaggtgtcgctyggcccctcctgatgcggggacaggctgcatacaagccagccaggtttcgggggttgagtgacggtcaggttctcccatgagccctggtgcttccaagaagtaaggcagctcatccacccagggcccagagcctcctcttcctctaggtccttaaaataaattgcaagttcctcaccccggccttcaaagctctgcccgatctgccacccgcctgcctctccattatcatctctggccactctttcctttgcttcttccacaccggccacactggcctcctttctggtgcccaaacacgaccgttcctatctcagggcctttgcacacgctgtatcctcttccccacagtgcttggcctcagacctctgcttagcaggcatcctcagaggggctttcttaaccctctgcctccctcccattggcactctctccatcgcccactaactcyctccctgccatttcatctgtttgttggctcctctgctgtcttggggacagtgactcccagagcccagcacagtgcctggcacacagaaagcactcaggacatgcaaccgaatggacatgcaacgtggagtgtgtccaagccagagaagggctgaatggcggctcaggactcccctcttggttacgtactcagcacccaggggactgctggttaaaggcttggggtgataactgtggcatgagagtggacagaggggcactggggagaattctccaaggataaagcaaggcagtcagagaggcgcttgccttcgtccaccctccagagaggagagcccactgtcatcttctggaatccaccagagcatcccctgcctccacaggcccaggagctagtggccaccccaggtcccctcattgaacaagccctgggccagccctccacatccgcgttcccattaaatattcacagttccacgattaaggaagtctcactgtctcccactgcagatggggaaagcraggcttggagcggtgaaggaatttgtcctgggtctagcatgaagctccaatgctggaacccagtgcggagcctgtttttcccaccattgtgttgtggctgccacctcagttcccaccattcataccattctcccatcctccctcgtgtgacattgtcagagagtccttctgagaccgcagcacatcaccctgggagacggtctcaaagacaccttctgtttccatttccaatgtaactttgtggctcagttcaaaccaggaaggcaatgaatgttgaggagaggaggcatagaaaacccagacccaaaggaagtcaattttcagaaacaaaactgcagggaggccgggcgtggtggctcacgcctgtaatcccagcactttgggaggccaaggcgggcggatcatgaggtcagcagatcgagaccatctggctaacatggtgaaaccccgtctctactaaaaaatacaaaaaattagccaggcgtggtggcgggcgcctgtagtcccagctactccagaggctgaggcaggagaatggcgtgaacccaggaggcggagcttgcagtgagccgagatcgcgccactgccctccagcctgggcgacagagcgagactccgtctcaaaaaaaaataaaaaaaaaatttaaaaaattgcagtaaatgggctgggggcggggggggtcaaggtatctgggctcaaatcccagccccaacactccctttgctgtgcgactttgatcaagctagtgacactctctgtgcatctgtctgcaattgtggaaaacaggagtcttaacagacaggcgcctatgtccagggtgctatcaggtttgacccagtatagtcaaaatgtgagctggagaggcaggccctgccctggaaagcggaggctagagggagccagggcctagtggggagaaagcatggtgacggtgcagtcagaggacagctccagacagcggcaggaaggctggagatcagtcaccaagtacaaagaccacggggtcctggggccttcccaggagccagagtggcccagaaggactggacttttaggcrgggcttctcagcctccgcactggtgacatttggggctggagagttctctgctgtggggccgtcctgtgattgttcagcagcatccctggcgtatactcattagaggccagtagcgaccccacacacaacccccacccagtgtgacaatcaaaaatgtctccagacattgccaaatgtcccctggggggtaaaaccgcccctgatcaagaatcaccgcttttaggtggcatctaatttacaaagttggtaaccttcacacaggtctcagctcaaacacctcctggtctctggcaggtaacagccaggagcaggagaattcagcccaggagctgccagtttgagacttctgtcccagaaggtgaggctgaccctagaggtcatctcattgtacagatgggaagactgaagaagaaagacttggccaaggtcgtacagcgggacggtggcagagccgggcctagaaccattctcagtttccccaccagtctcagtttccccatctgtaaaataatgagctggaccatgtggtcggtggctgcttggcaaactcttctccccacaagactcaagtggtgtttcctgcaggaagtcttccctcacctgcccccagctaacgtagacgtgtttctcccaagcagtgggagggtccctgtctcccttgcctcagctttgcatctgtctctccccgctgccagrcggaggaagactaggtcttacttgctttcgcagaccctctctgtgctgacccagggctgatcatcttttagccttgccataaatttaaaatttattcatttttatttgcctatgatgtatatgaaatatacagcccttcactcattcaatcagtgactaaaacacaccaggcactgcgctaagcacggcagatatagcaataaatgcagcaagcacratccccgcactggagcgcccagcttggttggggagatgggcattacagctaattctacaaatagctgaagctagttcgcaggacccagaagagggtggaagagtgaggtgcccaggatgcaaaattgaaggaggagctcgctctcagggtggtgcatgtgcactttggttctgataagtgccgcaaagaaaaaaagtgcagacgctctgaaaatatgagcagagagttggagcctaatcagggaggtagaagacagccaaggaaggccaccttgcatgggtgagacgtataaacacgtgcaccttccagggtcacagttttccactcccagagcccaagtcccctttataaataacaaatattttgttaacttctcccaccacttcgtattctaaaatgaaattcacagataatatactatataygtaacttcaaaaaaatcaatatcattccctaactttagaacgaataattacaaggacgtttgtattaaacttgtrtgtgtttcagtatgcaaatgcctggtcaggacaacaacaccagaaaacaccatgaggttgtcagatgcttccactatacatagaagcaccrtgagtgtgaccgtgacaaaaacagaggtacaggtgtgctggcagctctgatatcccaagcagcactgacatcagctgcatgacttttccaatacgatgaataactcctggtaaagttctgaacagaagaaagtccagttcttcccttgcttcaccaggcgttgccatttctggaaaattcagggtagattaaaacattggcaaaacatatttggcgggtttatatataaaatgaagttacagtctaaaattaatttaaacaagttgttgttcacctacctgagtatccactgggacactccaacattgagcaggacaagagaaggttatccatgagcagggctgtctygtgcattacaggtygcctggtgtcctcagcctctgctcacttcatgcctgtggcatcctctcccatccttgtgacaccctcgcacattttcagggcatgtccttatgggtagtgccaccctgctgagaatcactggatccaacctccagctaacagtggctcctgctcagaagatcttgttttttgtttgtttgtttgtttgtttgagacagagtctcgctctgtcactcaggctggagtgcagtggtgcgatctcrgctcactgcaacctccacctccctggttcaagcaattcccctgcctcagcctcccaagtagctgagattacaggcacccaccaccacacccagctaatttctgtattttcagtagagacagggtttcaccatgttggccacacaggtcttgaactcctgacctcaggcaatccgcccacctcggcctcccaaagtgctgggattaccagctgtgagccaccacacctgcccacggatcttgtttgttatctgtcaatctttgcattcctaatggtttgtttacttgcactgtcacgatcagggtcctttgcacactacragtggcttgtctttgcctccaatttgtgcacctccctggtaattatccttggaagcagaggaggcaacacaagcacaaataaagattcccaaggcagcagcccctggctaaatccacggtgattgtcttggccactccagcctgactccggggacattagccagctcccacgtgtgrttacagccagaaacaggccatttgtgtggtctggaacccctgctgattgttccttggaaaacctgaaccagaatgagctcttctatatgccagagaattttagctagaacagagtttcacacctgggcatctaatgtatgagacttgagaaggaagagagacaaagaaaaattcttttatttttctccttcacctgttggcctttccctaaccacccccaccctaccctctgcattagctggttaccttcctgcctcaaacagagaggccacatctgggataaaatgcatcatttcctggcttctgagcttccagttttcaggtcctcacaatataaaggtagggattttcaaaagtaggtgatagatattcatcttactggttatcgttggaaccaaacccatgaggatatgactctactgtccattaatcctaatcttccccatcaccagcaaggtaggtgttctcattcccattacacatgagaaagcagaggctcagagagggccgtgacttgctcagccccacactgccagtgagtggtggggtggggtttgtcccagatctgctgccaccagagcacacccttgtcatagccaccccactgtaaagccattttccctctcttagggtacaaatagctgtttaccctattttctatgaacaaatttccaaagatgcctccgggatgtgtgtgatcaagccagtgaattcaaaaatacagtgcttattacggaacttagtattatggaacttagtattagctggccacccacccgcctggctctaattaaaggcctgtccgtcttctgctttagaaatcatggctttctggagcctgtaatttcaccattcgtgctgaagtcctggagcactgggagtggaagaatggactccccacatcttattgaggctggtgagacagagacagatacaattagcatggcctgccactcagggacaagactaaagtgagttaagcgaagcactcaccttgggcacaaaaatccaagatcaggccaggcacagtggctcacgcctgtaatcctgtaatcccagcactctgggaggccgaggcgggcggatcacctgaagtcaggagttagagatcagcctggccaacacggtgaaaccctgtctgtactaaaaagacaaaacaaaaaaaaattagctgggcatagtggcccatgcctgtgatcccagctattygggaggctgaggcaggagaatcacttcaacccgggaggcagaggttgcctgccatgagccgagctagtgccactgcactccagcctgggcgacaaagcaagactctgtctcaaaaaaacgaaacaaaacaagatcagtattaattttttccttttccctttcactcccatatggcttagcacaccagtgttgctgatcctgtctttattgaaaatatagatattttgttcatcatggggggtttyacattaagtttgattttttaaatgttacattaaagtagtatttatcttgcttactgagttatttggcaatgccttaaatttcacacccttaatttttttcaccctggactcagccctgctgccatttcccagttcatgtgacctttgttaagtcacctcccctctttgaactgcagttttcccatctgtaaaatggagatactaaaagtacctaccttattggactgctggatctaaagtccctggcatacactaggcactcaataatggctgccattgtgggggaagagggaaaaccgtggtactattagcattgggaacaagacaagacttcacgacacaggactgtgcattgcaagacgtctcttatccctgggtcccactcactgaatgccagtatcaccatgataaccagaaacacctgtcctccctaacatttccaaaatgcctcctgyggcaaaatgccaccaccactgggctagatcactgtctttggagtcacacagccctgggctcaaattcagtttgtcacttagctgtgtgaccttaggcaagttccttaacttctctgagccttttgctttcttcatttgtaaaacaatgataacaatagaggtgacttgagtacttggatgttcagttttgggtagcagctattatgagcagtattttgtttgtattcaaagcaataagctcttcttggagttgagctctcttgtggcaatttgcagggtagggagggaaagagggggccagtgaccagaggggttgtaaagagaagagaggcagctctatcctgtaagcatgtattgtttgaactgaactgcatttacatattttaattagttacccacattaacaaattgggaagagttcaccaaaagaacccctagactttcacttgtttgtttctactgagaaactggaaaattagaccactctgggccacatctattccctcttggagctggtagtggccgcccacttgagaggtggcccatgcactccttcctggagttcgatatccagcctgctttggtcatttgcacttcctgcctagctgcagtagctggttaggttttcttttctttttgtttgagacaggcccttgttctgtcaccaaggctggaatgcagtgatgcaatcatagctcactgcagcctcaatctcctgggttcaagcaatcctcccacctcagcctcctgagtaatattagaaataagttttcagtgccgcaaaagaaacagcactcaaacataaatttaattttctcagcaaggcaattgtacttctatagaagggtgcatctcgcagatggagcaatggggagagcacaccagacaagggaggggaagggattctcatcccaacgcagctagttcctgctgctgtgtctttcccctattggctagggttggactgcacagtctaaggtaattccgattggctattttaaagaggcagaggtacaagctggagtggcagggtgagtagtttggcgggaaggatggttacagaacaggtgactcgggatgattaagaacagagcaggtgacccaggatgactaagaacagaccaggtggccaaagatgactaaggtcagagcaggtgatagaggctaggagaagattggttgctgaaactaggggcaaggagacgtaaagaacgagaaagttaaactttaaaatgaagaacaaagaacaggggagctgaacatactgatacattggttctttgaagaggatctcagaactcattgtacttaacaatttacaggctaaaacctttgaagacgaatttattatattctacagtagctgggaccacaggtgtgtgccaccacatccggctacgtttttaatttttagtagtgacrggatctcactatgttccccagactggtctcaaactcctgggctcaagcaatcctcctgccttggcctcccaaagtgctgggattacaggggtgagtcactgctctggcctggttgagttttcaatcccaaactggcagtasaggggaggagagagagcacactatgcaggaaaccagaaaaaagagttttaaaagtaagcataggattgctactgggttgtcaggaaagataagaaatctagtaggaattcggagtgcctcaaaaagtggatgaaggctgggtgcggtggctcatgcctgtaatctcagcagtcagggaggccgaggtaggaggatcacttgagatcaggagtttgagaccagcctcgaaaccccatctctacaaaaaatacaaaaagtaactggacatggtggctcatgcctgtagtcccagctacatggggggctgagacaggagaattgcttgagcccaggaggtggaggttgcagtaagccaagatcacgctactgcwctccaacctggrtgacagagcaagactctgtctcaaaaaaaaaaaaaaaaaaaaagwaaagaaaaagaaaagaaaamaaaaaagaaaataagtggttgagagaatctggatttttgtttgtttgttcagtctcccaagctctttgcaaattgctaagagccaggaaaatgttaacatcctggggaaggagccttcggagtagccacagcaggagcaaaaacctggaggctggactaattcttcattgcccaaggagaacaggggagggacggggagagaaggaaggagggaggaagcaaggtaggaaaatgcacggatggacagatggacaggtggataggtgggtaggtggatggatggatgaatagaagaaggaaggaaattgatagatattagacaaatagaagaatagaaagttgggtagatggaaggaggcctagttctgcctctgagcagcaatccattaataagcacttacagagtgcctactctgtgcccgaccctgtgctaggcactrtagcagagacagaaaaattaagtcaggactctccttgccaaggaattcactgtcttgttggaaggctcaaaggctsggtctgttgcccaaggcagctcaggtaagaagtaaaatccacagcagtgcttcaattctgctcacaaactgggctcctccactctggtctcagaattctgaggagaacagaatgatcctggcctggcttcctgtggggcctgtgagggaggctcttggaatgttctggagcccacccaaagggcagctcagcgaaggcaggaacgatgtcggtgttgttcactgctgcgtcccmgcatctagcagagtccatcctcataccgaaggcgttcagtgccacctcgtcaataaatgaatgagtaggtgggtctgagtcccattggctatggctgcaagcagttcctctcacttctgcaacctcgattcccctgcccctamgatggaactaacagtagtgactgtgccccactcatgggggagtgtggtgaggtttagaagagaatgagaggattttgaaagtgctttgtaaactcaggagaggtttacaaatgggaagtgcgatgctaatagcagaaagagtagtagaaacagcatcagtgtagcaataatggcccctgtgttcactgtgttaaaagtaggatgatgctgtcattcctggcagtggcaatagaagtattcatgagaatagtcgctgtactggcgatggcagtgatggtcatattaatggtggtcataagaataacattactggggccaggcgcggtgactcattcctgtaatcctaacactttgggaggctgaggcgggcagatcacctgaggtcaggagttcgagaccagcctggccaacatggtgaaaccctgtctctactaaaaatacaaaaattattctctggtttctcttcagatcgtataaatcttttgccttttactaaaaatacaaaaattagcctggcatggtggtacactcctgtaatcccagctacttgggaggctgaggcaggagaattgcttgaacctgggaggcagaggttgcaatgaaccaagattgtaccactgcactctagcytgggcaatagaacaagactgcatctaaaaataaaaaataaataagagtaacattaattggtagcaagagagaaragaaggaagaacattccaggaggaaaacaaggttctgattgcagttataagagacagaaatccaattcaaattggcttaagcttgaaaaaaaatgggaggggtgatgcaactgcgaagttcagaagtggttctggctctggcccagatacacaggcctcgaacaataccatcagtgcttgtcattgcaactcagtctctctccatcttttgtctctgccctcctctaygagggcttcactctcaagcaagctctttgggctccaggcttcctatctcccagctagacattttccctcaaaagagaactcctggccgggcacgatggctcatacctgtaatcccagcactttgggaggccraggcaggcagatcacaaggtcaggagatcgagaccatcctggctaacatggtgaaaccccgtctctactaaaaatacaaaaaattagctgggcgtggtggcatatgcctgtagtcccagctactcaggaggctgagtcaggagaattgctygaacccaggaggcggaggttgcagtgagctgagattgtgccactgcactccagcctgcacacagagtgagaccccgtctcaaaaaaacaaacaaacaaaaaacaaaaaaacaaagagaamtcctcctcccccatggttgcaaagttccaagatccactctcatgaagccatcttgtgtcacatgcccatccctcagtcaatcacaaaggctgggagrgttggtctatgctgattggaccaggcagagccacatggccactcctggagctggaggtggcctcagagtagagacatcagaagagggtgagagagaggtgcagggcagaggatcagtgggtggccttcagaggtaggaccagataaagacgccatgggtcccaggacctggtgcttggtaatgctcaacaattaatgtttttaattgtaaaacattaatgtgctgtaaagatagggaacaacccataggttgtgaggtagagcagccctgggttcaaatcccagctstgctacttgttagctgtgtggccttgggcaaagcacttgacctctctgtggcttggtttcttcatctgtaaaattggatgaaaatgatcgattgttttgagtattaaatgagttattgcattcaaagcacttagaaragggcctgacacattgtcggtactcagtaaatgttagttattatgttcattatctattcagtgtactcaatggtgccaacttatatgactcactaggattaaaatctcttccctccacctggatgctcctttcccagatcttcatacaactcgatactccatctttgggtctcagctcagatgtcacctcctcagagaagccctccctgactaccatagttgatgatgtccctacagccagtctctatcccattagcccattttcttgcaccttgaagagatcctttttaatttacctatttcctcatttcatgtctgcttcccccacccaaatatcagttccctgaagacagagtctgtcttgatcactgctgtgtcctcaggatctggaaaagtgtttggcacatagcttggctccataaatgtttgatgaatgaatgccccttttcttccccgatagtatttctgtgccgcatcatccatcagggaggacactggggcaaagatgtagcaaggggggaggggtgcagagatgcataccccaaatagctgggttggagcttcggggggagacctaggtgagcctgccacccctctgtcccccaagaagggtcttttagatccctgtccccggttgtgtagagggtctcagctctgggtggcctaagaggacaggagcgttcttcttgacttgggtcatcctagccaaggtcaggctaaagccagcaggcctgggattacacacccttgcacatccagctgcttagccggattagtgcagacgccatgcccacaggcctaggcccaagacaggggccccgggagggtgagtcacaggccacctcaccctcctactcctctggcctttcctacactggagaagcctcaagacctaccagggacctgacagagtggctgtattttctgtgtatattttcattactgtttattgaatgtctactgtataccaggccctgaacggggcactttacaggctctcagtcagtccttcagtctgagagactagggctcayttatttatttttaaaattcagttcctcaatagttattaagcacctactatgtaccagacacaggtctaggcatgagagatgctgaagttacaaagatggtccctgctttcatggagcttttagaggaaaagacaggcagggagtaaataaatattttcattttttaatttttttaatttttttttttttagagatagggtctcgctctgtcactcaaactggagtgctgtggcggtgacatggttcactgcagcctcgacctcctaggctcaagcgatcctcccacctcagccccccaagtagctgggactacaggtgcacgccaactcacccggctaatttttgtattttttgtagagacggggttttaccatgttgcccaggctggtctcaaactcctgagctcaggcgatctgcctatctcggcctcccaaagtgctgggattacaggcatgagccactgcgcccagccatgaatattttttaaatgctcttcagctcctcaagccagaggtgaagaagtcgggaagggaaaatgtggatgggcaggtagagctttctcgtgcactctataggcccaggaaggatgtttgtggcccataacccacggctgcttgtggggagctttgccgtctgtgagagaatagaatatggacaagcttttaccacaaatgtttgttgaatgactgaatgaatattctgctgttgctcagaagccttcccaagctccccattgtctgcggggtctggtccagacccctcagctgatgttcacagcacccccatgatctggccccaggtgctcctccgattcctctccatctcaggaaacaccaccactatcctcccagttgctcaggatgaaaacctgggattccatcttgactcttctttccctcgccccacacatctgagccatcagcaattggttgatttcacctccaaaatataacttgaatttgtcttccgtactgtgaacagacacagtctcttgcctggacacctaccacagcctcctcactttgattcctgtttctattccagtccccctacaggctgttcctaggtgcagctcggggattattttattttattttatttattttattttattttattttattttattttactattttttgaaacaaagtttcacgttgcccaggttggagtgcaatggcacaatctcggctcactttaacctctgcctcccaggttcaagcgatcctcatgtctcagcctcccgagtagctgggattacaggcgcccacccccgtgcccggctaatttttgtatttttagtagagacagggtttcaccatgttggccaggctggtctcgaattcctgacctcaggtaatctgcccacctccgcctcccaaagtgctgggattacaggcatgagccactgcgcctggctagagctaggggatctttaaacctacattaggccatggccgtgtggctcccaggattctcaggttaaaaacatcctatcaggtcttaaaggcctgcctctcttctctctttgacctcaactctcacgccctttgtcttcctccctagcaccagggacactggtcgcctttctcctcctcttcttgccaatctcttccctgccccaggacccttgcacttgccgtgactgctgcccggacsggcctttccccagatctttgcgagctggctcctttgcattcctcaratccgcactcacgcatcacctcctcagtgaggccctccaaagccgttgggctaaagtagtcccctatctcctgcccgtcttttttaatcctctaattctgctttactgaggtgtggtaggatgagcggtggggactaggaggagcttcagagcagtctagaagcaggagagacgaggggaaaatgcagccaggggctctaaggaagcagcaacatggcttctctgcagccatatacggatggatgaggggctggcccaggcagggattccatccgcatattcctgatccagggcatctcgcggacccagctcttggcccagcattccctaaggaacccmtgactgcttctctggcactgtttaatcttttccctcatcgctggctacacgtctaatgatttattcctgggctcccaaaccagattcctgcagaagccaagcgagcctcataaacaacacgcacagggtgcacgtgagattttagagtacaggactggacttaacaccgcgcagcggcagcctgggcttgccacggagcagcgtggaccaagagtacccagagcttcagatttttcttgagaagctcaaatgtgaattcatagggaaaataaatattggcaacgaattcactgtgtgggccaaaactccctgccggtggatgagtggggggccgtcctgctggcagggtgtcctcggttcacatgcgtaccctggggtacgcattttccatgcatgatttcattgctgcctgacaaccacctgtgcagggggtattattctgagccccattttacagatgaggaagctgaggctcagagagttaatgtgatcatmcatgccagagttcaacctatatctagaactaatctgcttgcccaaaagctgaagtggttccaaactctgtactaagagtgtctacctgttttgtctgacttcatcttccgattctgcctgtttcacacgggagactcagagaggttaagtaatgtaccgaaagtcacccagctgccaagggccaggattggaacccaactttgtccaaagtcaaagtttgtaggctaaccccttactctctatccagtttcaatatgaaggagctttgagaagttcaagtgrccacagaatcyttggtggtactgaaacaattatctgtacaagatcctactaagcgtaagccctgagaagtgytaagacttctggcccttctatggaaaccctgtgttgcagccagggctcttagatgacacttttttggagagagtgggatcctcaggaattttgttcaaatgctgacatctgaccgcttgttyactttatgtgtcaactcctgggctttggttgctcctgccagaccccagtgcaggctgggagagtttggaggattccagatgcaatctagaatctgcccagaagcttgcggctcatgggggagcttccaccagtgggtatacctcctcccgtccttctctccaccactccttgatctatggaagaagggaacaggcatttcttgaggacctggtagrtgccatgcactttctttgtgatatctcagtgtgattcagccccttccttcctgtggatcctaaacgcaagtcattttacctctatgaatcttagctctctcacctgtaaaattaagataacaattttgttmagtcagatcactttttatttgcaagggtcagaaatccagcccaactggcctaatccaaaaagagcattcatcagttcatattgttggaaaatccaaagggatggcttcagggatggctggatccaggtgctcaaataatgtcattagaaacctgtctttgtgtcttggcacagagtccctctgctttggctacactcttgggcagattttttttccccagagagccagagttgaccctccagccacttctggttgatatcctgttaacccaacagcccctgatgaaagagaccacctctttcccaataatttgagaaaaagttccaggatgaaccctgattgaccaattttagtcatgcccacactactaaagtaatccctgtggccagggagatgaattatcctaactggtaagcttggatctcactcttaccccctgaaacggagaaacagggtcaacttcacttaatgcgtgattgtggaggaggaacaattcccaaaaaatgatgctaaactatccaaaaacatatccaccacactaatacctacctcctgggtacttgtgaggattaattgagatagtatgctgtgcctggctcccagtacmtgctcagttactccatagccagccttgtcaactccttcctgaacctctgactatccatctctgacccagcctcagagtgagacaggcatgaattcaagtcctaatcctgctgtgtggctctgggcatgttatttaggggctccaagcctcagatccatcctctgaaaaatgaaggtgaaaagaggagctacttcctggggtgatggtgaataaatgctttggtacctcacatgtcrcrggtgtgcagtaaatggtggtctcccctcttgccagttttctctctgtgtgcacacctgccctagccaaactggcttgactgttattccccacctccaaccctttgaatatgcagctgcctctgcctagaacacccctactmccatctctgcctgctggaatccatctctagccctcaagccccagcccaaatgtttcctcctccaatggaacctcacctttttgaggcttggttttcacaattgcaaagcaggaattacgagagtatctacctcctggggttgatataaggagtaaatgagatcggtcatgcaatgcagttggcgcagtgcctgctttggtgagaaatcaataaawctcagctgttattayatcattagtatcaggcatccagctgctaattcaagcttgcattttccaatagtgccttgcataggaggggtgctcagtaaacatattgcatttgggtggtccgattggggtcatggcttctaaacccatccatccaaacttccatccatccatccatccctccatccaactgaccaactcacaaaccattcacctgttcattcattcaggcagtcatttagtgcaccagtatttgttgagtgccaatgccacatctggctctgtgctgggcagtggggayccagccttgtgaaatagacacagtccctgcccttgatgtgctaacctrggttggtggagaagcggaaaataaatgagtaaacaaacaaataaacaaaatgatttggccaggcatggtggctcacatctataatcccgtccctttgggaggctgaggcggaaggattccttgagcccaagagtttgagaccagcctgggtaacayagtgagatcttatctctacaaaaagaaaaaaaaatagctgggcattgtggcacacatctgtggtcccagctactcaggaggctgaggtgggaggattgctggagcctgggaggtcaaggatgcagtgaaccatgataacatcactgcacccttttgagaccctgtcaaaaaaaaaaaaaaatgactgcagattgtgacaaatcaccaaggaggtaaaacagtgcagcaagagtgagtgactgaggaagaggtatttttaatcaggcagtgagggacagtctctctaaggagagactgtgagggataagaaggagccagtcacagacaatctgggatgaggatgttctagacagagaaacagcaagtgcaaacgtcctgaggcaggagtgggcttggcatgtggaagagcagacaggtggccagtgtggctggaagggagtgactatgtgcragagcacagagaaaaagagatcagagaggtcaacaggggccaagtcaggcagggccgtgcagcctccataagagtttggaccttgtttcaagtgcagcaggacaccactggaggactttaagaaggcgagtgatgaaacttcacaaagactgctgtgacagggcaatgaaagggctgactcaacttaattcagtctaggaaaagctggtgacattgctactgagtcccraaagaaggaagaaagcaaactggtgaaggggcaggggaggtggcaggaaaaggtctctccaggccaggcccagggaacagcaaatgaaaaggtgccgaggtctctgttgacctccctcttagaacaggaaaatgagaggctactgagagtccagaaagggaaggaaggaagggtgtggagtggagccagttaaggacacagggaactactcaagttccatggaatggagttgttttctgagcaacttgttcccagtccattgctacgttattctgggcaaccggtgtctttttgcctgtgttactatcagatgggttggcagtccatgtgtaagttgtactccatattctccatatactggagaattactgggctaaccactgcagtgctgattagaatctaggcctggctctataacaaagtgagacccagggagagaagtatatttctctcatcagtccagatgaaaatagtccacgactagtaccatggctctataaagtcatcatggccccagcctcattccacctttctgctctgcttttcccagagtggggttttcagtctcacgactctcagtggctgctagagttccagcaatcatgtaatcatccctggcagcaggatggaggaagatctaaaaagaggaggcagccttccctgctttaaagagattctggggctgggtgcagtggctcatgcctgtaatcccaacactttggggggccaaagcgggcagatcgcctgagctcaggagttagaaaccaccctgggcaacatggtgaaaccccatctctactaaaatacaaaaaaattagccaggcatggtggcgcgcacctgtaatcccagctactccggaggctgaggcagagaatcgcttaagcctgggaggcagaggttgtagtgagccaagatcgtgccactacactccagcttgggcgatagagtgagactccttctcaaaaaaaaaaaaaagaaaaaaaatacgaaaaacaaaaaagaaaaaagagattctagaagtcccacacaacactccgactcccatcttattgaccagatccaagcatgtgacctccatccagctgcaggggaggctgggcggtgttatcttcaagcaaagtagtcacgtaagcacaaaatcaggattctgtgaaagagtagaaaatggatacttgtctcgtgcacgcatggctttcctcaaagtggcccgaggcccatagaaatctcacccctgagcattaagaattgagagaatgggaggtggcagggcgaggcccccaaaggttgaagccaaagctcaaaattgcatgaccagagtcacctccttgtcactttcctggacaattaatgcaatcattccttacactctagtgagtcaacctccccttcaacaaccagaccaaggacttggagtgttgctgccctgaatgttttcatgtgggacagttgaataactgaagggatcttccaggagaaccacaagaatggatgtccttgttttccaaagcaggtccttagtgggggacaaacaagggagtcagaggaaractgctgctaatgatactaataataatagcrtgttctgcactcaytgtgtgtggcctggaggcactctaagatctgccccccttaccacattccttactgtcccctccacttaacctacttcagccacgcttgccaaacacgttcttacctcaggacctttgcacttgctgttccctctgcctggaatgcttttcccactgatggtcatgtggccagctcctctttatcattcaggtctcagctcaaatgtcacatccacaaggaggccctccttgatcaccccagctaaagtaaaccatctcatagtcattctctttcccctgaccagcttcattttttcatagccattatcatagcctgaaatgatcctgttgacttattattgttcactgtgtgccccttccctctacaaaaccatcagctcygtgcaaactgggatttttgcctgaattgtttactgcagtattaccagggcctaaaagattacctggcacatccccacatgaatgaatgaatgaatgaatgaggtaaatccttmtaagaatctgaccatgttrgtattaatagtccctttttatagatgaggaaagtgaagctcatggagatgaagttccttgtgtaaattcaaacagccagtaaatgtcaggggcaagatttgaacccagatcttgctgattccatccttctctttggcctccctccattgcataataacaatagctcattgtaacagctcccaccattagaacggtcgtccttatatcgaggcgaagtactcctcgcagctttaaaacaaacgaacatctaacattcatcgaggccttactgcgtgccaggcacccccgcgcattatctcattgaattcccacatgacaacccagtgagggaggaactctggtgatccccattgcacagatgaagaaattgaggctcagggaggttaagaaacttgtccraggcctcacagctggaaaattgaaaacagattaaaatgcaagtcctggttcttaaccaacacattctagtgcctccctccccctggatctagctcattcattccttatcaaatttcatttatcctgccttctttctttctttgatgaatgaatgagaatagggctcactgtaaaagagagtagatgaaaattcacatacaaagagtcttcctgatcatttcaacccttttctggccaacctcttgtcagatctgatgagatcatcattatttttaactttgtgttttcactgccaaagggctcagaccactggggtgggggaagcatcagttcagccactgtcttgatgttctcctgtgtttccattgctaatactacccccaaacccttgtggctttaccaagatctttatgttttatttttatttctttagagacaggggggagggagggtctcactatgttccccaggctggtctcaaactcctggccttaagtgatcctcccgcctcagcttcccaaagtgccaggatcataggtgtgagccaccatgcccgttttccaggatctttgtaagccattcatctttgtctgagaggactagttagcttaaaatcagaaaatagaatctgtaacctgactcgaccagatgaattagtgagaagatgctagattgtgctacagtaatgaagaaatccacaatctcttgactttacccatcaaagttttgtgtgaagaactcacacccactcttaaatgcctctgccagtacccacacagagcccatacagaaccagatatccccgccccactgcctcgaggaaatagacattttgcccaggaagaagactggaaccagacacccatgagtgctagaagtctcttcaccccagacacacatacatggcactgcggccatcaaacaaagatgtgagggcttccttgccaaccccgctaagctgaagcacccctactctcccgccaggggtcttctcctttctccatggctgcctgacatactgagtgaacaaggatcccgatgttaattcatggacttaacatcaggaaaacttgatttcttggtttgtttgtttgtttgtttttaacagtaaagggtagaaatgccagtcatttgtttctgcactgcagtgtgtcatattgtgcacacacccatattggggaccatctccttagcctgttataaagcattttgtaagtttcaaagcacttactgtgtccccctggaggacacagtaagagaccagaggcctcactgttgagggagggaatgatgtgtatcacttttgggtgcgggcatttaagagcaagtgtgacttgcccacactgtcccttcctctgccttggcaagactggaggctaccaattgagatggtagagccactaggttcttgagtcaccacctagaaaggaactgtactggagacccattagactctcagtggatcctgcatgagaaagatcagagatgtgacgacacttgccgaagcatgcccagccagaattaaaagtaggtctccygactacccacgtgtccatttcacctcaatatgaatctctggtgagactaaactgctataatttcataatagatgagaaagatctattgttaagccaccaaaatgtctctttcaaaaagtagattggacattaaccagtaaatctggctattgtcaaaaaaagaccactcacagagccattattctgacattagccagagtactacctaaccccagcatctctccagactcatataattagcttccattagcaaccccagccaccttggtcaagctctcagagactaccctccccagtcccctccagccagactcagaggacaaggaaaccggtttgtggccggcagaacctggggacactgtccttgcctaacacttcctgtgctcctcatttttcattcaatacattgctctctacaacaggaatggacccgtgccattcatcacggttaacactgacagttcctcccccacctgctcatgtcctcagcaaatatagggaattggcaaccacccaggcagggagcacactgtctcgcatttctccccttcagaaacaagcctcttcatcccctcttccctctgcagggatcagttttgagtccctcttcctcctccaccagagaccattgtcctcaggttggcaggagatggtgacatcaccatctcccagaattcctgcctttggagaggcttgtgggaacctggctggcctgttaggaagaggttgcccaacccagagcttgttaagaagagtgcagttacctcagagagacggttcaagtgaaggcataagttaaaaaccagaccccaggatactaggataagaaaggtcccaggtatgtatattttttaaaataaagaagggcatcaaagtctagtatacatcagtttaaactctctctctactactttcttcttcttcttcttcttcttttttttttttttttttttttttttgacagagttttgctctgttgcccaggctagagtacagtggcatgatctcggctcactactctgcctcccgggttcaagcgattctcctgcctcagcctcctgagtagctgggattacaggcatgtgccaacacacctgactaatttttgtatttttagtaaagacaaggtttcaccttgttggccaggctggtctcaaactcctgacctcaagtgatctgcccamctcggcctcccaaagtgctgggattacaggcctgcaccaccatgcctggccatctactattttcttaattgttcctctggacatttgttcttaagcctcagtttccccaattataaaacaggtggaggcacagcacagcctgtaggattgttatcaggatgaaatgagatcctttgttccatagatatgtattgagcaccaactatgtgctctaaggattcaagattgagaaaaatcagatataacccctgccctcacactgcttacagtctgcagaggtggacattactgcaaaattgcaacttgaacagtgttatgaggagaaggataatagtactatgagagtctgtgattgggatttgacttggtcaggaaagtcaaggatggcttccttgaacaggtgatcttgagctaagaaggatgagtaggaagtaaccaggcagagtgaagggaaaagcactccgggtggagggaacartgtgggaaaggtcccgtggcaagaagatagtgaagactatgaacgaccaaaggaaggttactggttaatgtacctgagatgagggggcagagaagagcatggaacaagagaaggctggaragttagtcaggcagggagagactaagcggctgtaacaatgagaccccaaaatacagkgagtggcttcaacaagatggatgtcatgagatagaccaggagctggcaaactttttccataaagggccagtctagcactgagattcgcttccatctcagatccaagacagttgctccagctctgcccagcacatctgcctgccagccagcaaggaggaaaaggagacagggcttctattatttctgctcaccttccattggccaatgttaatcacatggccacatctaactgcaagggaagctgggaaatgtagtctttattctgggcagccctgggtccagctaaaactctgtgacaatggaagaggggaagaatagatgttggtgacagctagtggtctttgcaatagtgggccagagagtggttttggggaggccagaaagaagtcctgatgcgggaggrtggggactgtgcaggtggagagaatggaacagatgcgcagatgttggtgaacttgaattgatcagacttagcaaccactatcttcttgccatggggcctttcccacactgttcctttcgcctggaatgcttttcccttcactctgcatggttacttcctacttatccttcttagctcttagcctgccycctgcaggctcctgtctcctgatccctgggtatggrgatagggcagggtatagcaagtgtgacccccatgttcctggcttgtggagtctgatgcagatcttgtctggaaagttcttcataccctatggcaggtgttgtcttcattatcgcctcaggtgggtcagtgactgcaaacccagctgcctgcagagacagatcacaaaacaggtgaagggcctgtggcacactagggagctggttcactctcccaaggggttgctgttccttagctctagccagtggttgccactgggaatgcaggttgagtgaagacgagcatctaattttccaaaagaatgtgaaaatctggatttttatgtaaaatctcccaattttgaaactcggtcaaccaagtaaaaataaacttcccagcagcaaagcctctgggttataagggctagggcgccctccacagtggccctccatcctctttccatctttgtgactgttttcttctcatggcaaagccctctgctttcatcctttgttgtacacgcacaggattcctgtccctttgtgcccacgagcgccccctgcaggcttctgactccaatgtcttaccaatcctctgccagggacccctccctgcctgtaggggatgcgggcaaccccatcagcctgctcccaatccccttaatcggatctgcaccagtgacccttctaattaaaactccccagctgtaatccccccttaaagctgggggaagcggaagcaccataaaaggaccgaaggtttgatgggccagcagccgcctcctcctacgtccttgaaaacgtcttgggagacccacagacctgagatcaagtccatgggtctggaaccaccgcttacaagttgcgagactctggaaaagtcacttcattctctcagcctccattttctttattcacttgttcattcatttgtcagctatatagaaagctcccatctgtaccaagcactgtttcaggagctgaggacacagcactggacaagaccgacccagttcgggccctcatggaggtgacactttagtgtgggacagaaaggagaaaacagtttcagctcagcagcaccagggctgtgatcagagatgcgcaggggctgtgtgagctcagagaactgatgtacctaatgcagaccgggggcccagagagggctcgctggggcaagtggccccaaagctgaggcctgaataggcagtaggaaccagccaggagaagtgggtttggagtaggaggaagggtactccaggcagagggaacagcaaagatctagaggtggaagcacccatggtggtgagtttgggaactttaagtggtttctgcaggattcagtgtgggwtacaatgggaaataggggaaatggtcaggagagagaagaaaagggatcttaatataaaacccagatctcttcatcaggtctcatcaggcccaccccgctctcccgctctcgctcatgcagccccagccatgctgagcttctttgggttgcttgatataccaggcttattcccacccaaggctttcatacgtgccgtgccttctgcctagaatgttcgcatctttgaatgacacacacttcttatttttaagtctcagcaacgagacacctcctaagagaggcctgccctgaccactctgcctcccgtggacacccctagtgcttctgcatcgatccccctggtttgcttttctcaataactcacagcatctaacactatctgacatcaccttgcctctttcctggtttacgtttttgggtttttttggtctgcctctccctgctagctccatgaggctaggaaattttcttccttattcatgcagcaccctcagcaactagcatagcacttaggaagtgctcaataagcacatgccaactaaaggcacaggaactggaacttaactgggagaatggggagtcgctgcagggcttacagcagctctgtggcttgctcagcttcttctctcctatgaactatccatatgttgtggggatggaaagcaatgggctgacatgggcaatgtggcaaaaccccatctctacaaaaaatacaaaaagggaggttgaggctgcggtgagccaagatcacatccctgcaccccagcctgggcaacagagtgagatcctgtctcaaaagaaaaaaaaaggcccggtgcggtggttcacacctgtaatcccaacactttgagaggccaaggcgggtggatgacatgaggtcaggggttcaagaccagtctggctaacatggtgaaactctgtctctactaaaaatataaaaattagctggacgtggtggcctgtaatcccagctactcaggaggctgaggcacaagaatcgcttgaacccgggaggcggaggttgcagtgagtcgtgatcgcgatactgcactccagcctcggctacagagcaagactccgtctcaaaaaaaaaaaaaaaaaaaaaaaaaaaaaagaaagaaagaaaaaagaaaagaaaagcaatagcaatgggctgccctttatggaaagcaactttttatataactttatcgaggcttactttatgtatcatataatgcacacccatttccagcatacaatttgataatttttattaaattttaccaaatcgtgcaggctttgccctaartcagtttttagaacacgacgtcctttatgatcattaactgttaatccctatcccccaccctggcaaccactaacctactttctgtctctatagatttgctttatctgaacatttcatataaatggaatcatataataagtggctttttgtgtcygacttctctcacttatcataatgttttcatggttcgtctgtgttgtagcatatatcagcacttcattcctttttatggatgaagaatattccattgtatggatagctgcatttcgtttatccattcatcagttgacggacattggggttgtttccactgtggggctattatgaatactgcagctataaacctgcatgtttacgaagagcaatttgcaagccctaaacactaggtgcagcttccagcttgccaaagcttctagtgttactgaacagtgttgacagcaatgggctgtgtgaccgtgggcaagtcacttccgttctctgcttgagtttccccatcttcccagcaggaagcttgagcccttttctgcatggacagtctgtgcctcatccacattcctggaacagcagggaagtgtgcagaggccacgataaacagtccgtaggcctctctgtgattaaccaccagagccgacgattaggatgaggagggcctggctccagcactcctgaattccaccctggggatccccacctgccaatctcttcccccagaggaccaaagccccctctcccatttggtgcagacaggtaggctccaggatccagaacctcttcacagggaatttggggacagcctcccagtctctggagctggctcctgcctctgctccccgggttcctggagttctgccaagcccaactgggctcagatcccagaaaagcagaggcctgtccaggcctgagctggggctgggaggactcccaggtggtagtcagttccccattcctggggcttatcccagaaaccaaatcaacacagtccatctgggtccacgagctgtttagaggacgcacgctgccttaggcagtcactggggtctacacagctactcctggcttccaaaagcaaccagtacagaggttagggatggggttgaccataaattacctgaataataatttatttatttgagacagagtttccctcttgtcrcccaggctggagtgcagtggctcaatcttggctcactgcaacctccgcctcccgggttcaagcgattctcctgcctcagcctcccaagtagctgggattaaaggcacccaccaccacacccggctaatttgtgtatatttagtagagatgggtttcaccatgttggccaggctggtttcgaactcctcaggtgatctgcccacctcggcctcccaaagtgctgggattacaggcgtgagccaccacacccggccctgaataataatttaataacattatatattaagtggcttttaggtgagtactcagttaccttcatcttcatttcagagaaaaggaaatagaggctcagagagggggagtggcttgtccaaagccacacagctggggaataatagccttgggactcaaactcaagtccaaaaccagctataaataaatgtaaagaaatgtggagaaataaatacaattaaagtttaaagtgattgtgccactagctaagggcattttgagttcawtgaattttcattgcagtcttgcaatgatccctgtcttacatatagggaaactgaggcacagagggcttaaatcacgttgggaagttccccaggcaggaagtgtggccctgattctaagggcctcactgagtctgggaaagaaaaagttcttgcaggtggggtcaggaggggtggggcaggggagaccccccacactgcattaccgcatacgctgtgtgatgcacattcacacagaccgatggcaggtgtgctctgaccctcccaacccaaccctgagcagcaggcactcccccacacccyccaccttggagtccagtggagcccctccccctgctttgctcgtttcctaggcttccttgggctgagggaaggggagagggagggcacagtctcaagtacaaaaggggtgcctgctttaggtctgtacaatagctgggtgcataattcatgcatctgtcgccagaacatcaattatgtgggccttccctggagttgtctgggggttagaaaccaaagcaggcttcccctgctagcctttgggggaaaataagactgcccagctcttaaaggaacagactcccagggaacccattcctccctgtgcaggcgccctcctgccagaagtcaccagacgagagcagcttcctgtagggctcagcccaaagcccactggctgcccactctgacccactctgtgtccccaactccacaattgtgaggggctgactattggcatgtcccagagtttctcaatctcagtactgatggcatttcaggctagatcattctttgccgtgggagctgtcctgtgcattgtagggcatttagtgacatcccagacctccacccccaagatgtcaggagcacccctcccaccagttgtaacgaccaaaaatttctgccaaaattgccaagtgtcccccaggagtaaaaatcatccccttaaaaaccactagtatgtcctcattttacaaataaggaaactgaggcagtgaacatttggatgcccaaggccattccaccaatgaatggcaagagctagaatttcaactccaggacccacactcctcagctcaacacaggagcaccaaaaagtgtgctgccaagatgttattccaacaattacatatttattttggtgaatatttaatacatatagccctggcatgaaaaatcagcaattttgcatatgatttcttagaataaagctaaaataaaataaagaaggtgagtgggcttttttgattttttgtttttaccattaaggaaagagtgatacaagtagcaaaatacatacagtataacgtcaaaactgagcaaagtccaggtgcggtggctcacgcttgtaatcctagcactttgggggccctggtgggaggattgcttgaggccaggagttcaagaccagcctgggcaacatagtgagaccccatctctacaaaatatagccaggcatggtagcatgcacctgtagtccaagttacctcggaggctaaagcaggaggatcgtttgaacctaggtattcgagctgtgattgcaccactgcactccagcctgggccacagagtgagactctacctcttaaaaaaaaaaaaaaaaaaaaaaaaaaaaaacgcaacaaaatgacaatttagggacccatatattcttattgaaaatcatacagagaaacaaagggacgaaaaactgcacacagaggttatctctggagtgggaaagacacaaaggaagtgtcagtgttactgctgcctgctctgtctctccatttgggtggcgggttctaggtgttcatttgattatggttcataaattatatataaattaggtctatttttgtatatatcaaacattttattttctttattttatttttcagacagagtttcactcttgttgcctaggctggagtgcaatggcatgatctcagctcactgccacccccacctcccgggttcaagcaattttccagcctcagcctcccgagtagttgggattacaggcgcctgccaccacacctggctaatttttttgtatttttagtagagacggggtttcaccacattggccaggctggtcttgcactcctgacctcaggtgatccacctgtctcagcctcccaaagtgctgggattacaggtttgagctactgcaccctgcctcaaacatttcatttataaagtattacagaatcttcctttttcaatgggtgcaaatcaagaaactcaaacctatttttttttaaacataggatgtgtcagacttaactatagcaaaaaaatcagaagttatggaacccctgaggctggggaggcaccacaccttggaacattccctttcatcttcagagctggcccatcagggcactggcactctcttgccccctgtggcatccccaatgtctggcctagtgcctcacgcagagtagatgaccaagaaatatttcccaggccagtgcagtggctcacacctgtaatcccagtgctttgggaggccaaggcaggaggacagcttgagcccaggagttcgagaccagcctgggcaacaaagtgagatcccatcgttacaaaaaaggttaaaaattagttgggcttggttgtgctctcctgtattcctagctacttgggaggctgaggtgggagaattgcttgagcatgggagtttgaggctgcagtaagctatgatcacacccttgcactctagcttgggcaacagagaaagatactgtctctaaaaaaaaaaaaaaaaaaacctgaattctggtactgacccttctacttctaactccatgaacttgagcaacggccaacaaatacttggtgagcacctgtcaggtgtcccaccctgggttaggtgctgggggcacatagataaacctcagaacccatccccatcctcccagtactcaccaattctgggcagcaataagcacactcactcacgtgcacacacacacacgcatgcacacacacacacgcacgcacctgtgatgggatatgagtggtaagtatccccaaggtatggtaaaatggtgaggaaayccaaggatggagcagtcaaccctgcctggggaaagcagggagaactccaaagggaaggggycacatgggctggatttgaaaagatggattggagttcaccagacagcaagcaagaagctcggacatgcagaattgaccaatgatagtgtgcggctagaggagtgtgaattttgagaaccgatggcaggagtggccagagagagaggtcagagtcaaaatgagaaggacttgacaaccaagtgtccttactggggattcattgcagggccagaaacctcccacactcacccatgtagcaattgggttgacttacaggatacagcagacagtctcagaacaaggacaggaggcaaagaccgagaccgggccaccccgaggctggtgatctgagtgggtggggtgatgtgggctgagatttcmcctgtgatgacagctggcatctattagacactcaccgtgtgctgctggaagctgtcctagcactttgcctgtgctaacacatttcatcttcacagcagttctctgaggtagatactgttattatcagcccatttkctagatgaggaaactggggcttagagaggttaaataacatgctcaatgtaaggaaatggcagagctgaggcttgaacctcaaacaggctgacaccagagcctcagctcttaactgctgccctcggcaccctgctatgaccctcctgcggtccccactcctccttcatctgcaccttcccttcattctctggcttctcttgaaggttcagctttctttgtctttttctttcgtttgtttgtttgtttgtttgtttgtttkttgagatggaatctcactctgtcgcccaggctggagcgcagtcgtgcaatctcggctcactgcaacctctgcctgccgggttcaagccattctcctgcctcacctgccaagtagctgggaatacaggtgccgccactatgcccggctaatttcgtttcttttttttttttcctttttcttttcttttgttttctttcaagacagggtttctctctctgtcacccaggctggagtgcagtggtgtggtcatggctcaccacagcctcaacctccttgggctcaagagattctcccgcctcagccttccaagtagctgggactatagacatgtgccaatacacccagcagatttttttattttttgtagagacggggtctcactgtgttgcccaggctggtctcgaactcctgggctcaagcaatccccccaccttagcctcccaaagtgttgggattacaaatgtaagccaccatgtctaggctaaggctcagctttctctgatgtttttatggcatctctgtcccctacatttgggagacagttgcttgagggttgggcttatcatgaagctgattcaagcctagattctacttaacatttaattcagggacttaccctcccgtaacccactcaccgcctgggttcctgaactcaaatttctcaaaggtaggctggctaagccccagtgtacggattggcttaacttggatttttttatccaaacttcatgctctgatcattggcaggcaggatcaaatgatacaaccatggtgaccaggccccccccttcccacttagcaggggcagaggaagagaaagggaaaatctacaaaagcaagacaggtataggggacccaatagacaggtttaggggtttggattttttcatgaggagccctggagatttattaaacaaaggagtaatgtgattggatttgtatttttgaaaaaaaaaaaaaagaccctcagagcaattgattacatctgtttgcttttctgcatagtctgtagactggcctactggcctagattccattaatttcaacatatatccattgagccctttctctgggccaagctctcttcttgatccaggggactcaaaggtagttaagccaaggtctttagcccccaaaagcacatagttccaatcaggagttaacatgggcccagaatgtctgtgcctccctaggaattacctgcaaaatcttgagtgtctaggcatttttctagcaaaaggttagctttcatctgatttttttcccctttgttcttctatagagacagagtctcactatgttgcccaggctagactcgaactcctggcctcaaacgatcctcctgcctaggtctcccaaagtgctgggattacagacatgaggcaccatacccagccaaatctgatttttaacacagccttaagagctcatgttcttgggtcacacagacctgggttaaaatgctggctcttccacttactagctgtggaaacccaagtgtccgcatctgttcaatggagctaatagcactgaacggggttattataagaatgaaatgagctatttcatggaaagtgcctagcacacaatgaacactcaatcaaggatagttattatcattagtatcatctctgtgaaggtagttccccatccagtgtgagccactggtctagatcagaagtcagcaaatcatggttcacaggccaaattcagtccactgcctatttttgtaaataaagttttattgaaacacagctatgcccattcatgtatgtattatccaaggttggttttatgctacagctgcagagtcgagtcgttgtgacagacaatgcagggtttcagggcctataaaatggttactatctgaaaaagtatgcttgaaccctgggcttgctgatagctttaaaacatttcatttctctgggccttggtttccacatctagacaataaatggattacaacaaattctctttttggctcattaaatgactagtgaaatgtgaaaatgctcttgaacattgaggagtgccctgtagatccaggatattatgatgatcatcctgtggggtggttgataactaaatcccactctcttctcctcacagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagabtgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggcyccagtggtcaggaaaagtgcaaacttgagaaccacatctcccctgacgtccgtgtgttgccagggggaggagcccatggaagcacacgagatcagarcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcmcagcgcaaaacccttactcaaatgtcttcattgacttcggtatttcatagtaccygagattttwttttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcamaagatatgcaagtgtcaaatatgcaaaagaaatagtttattcaaagagactgtgtgttactgaagaacagcataaaaatatgatttttttacttgcaaaaatgaaaggaaaaaaataccacgcrttgaaatgcccagttcagactgaataattcctgctgcagcaaggaaagtacctactataatagaaattctgttttgttttctgtggttttcaagttaaaaaaaaaaaagttaaaataaaaagcactttatgtttttcaaaaataggttctgccagggacagtgtcaacatcttgcactttaaaataagcactatttcccatagcccaattgttgggactgtagttggattgttgctacctgcccatttctggccagcatgggtaatattgtgctggtattactgtctgccatatcaaagtctgtgggctccttccctgcccctctgaaaccttcccttaaccctcatgggtcaggaggggttcttgccccttgggtggggcctctcatgaagtcaagtatacaggagacatgcacatctcaaaaggacacagtgacagttggacattgggtgttttactctgttctctttcttgtcaaccagctattggtttttcagtgtcactgtctgtactaaaagctcaactctccttcctgcagccatcgatgcagccagtacagacaaaagcaataagtatttgtgtgcatcctgagtggttctggtgtatttcttggtgttggttttcctgtcctcgtttgatgacctggcattgtcctgcctgcttttagtccaacagcatggtgttgttggccattcctcagtacagtggcattaggttgaaccactgatgaatacaatgctatagtgttggctcacctgtcagtaaagatgacatgttattggtctgcctgtctgtagtacaatggaacaatgttgttctcttaatgtaatgttgatggatgatgtcccaagtacaatagtgtagttctgtctatcctcaatacagtaacaggcatatgtcttcccagtggaagaaagatatggtattggttcacctagtcttaagtctcaatatcatctgttgctggtctgcctgttagtacaatggcatgatccacctctcagtacacaaatatcatggagctgttctgcctgctcttcatacataaggcataaggttgagccacctgccacacatatgatgagatgggatcattccaccacccttaaaaatatgtcttctctgctgtatacaaacccaattcataacacttctcagcatctccagagactgtagatccccccaagagggtgcagtcctgttctttgccgcattaacagagaaaacgagaacgtcactcttcctaggtatcttcagagtattcgcgcagcaactgcaaagggacttaggggcagggagagtgtgaggtcatcccgtgccaggcagaggaagcagcactcccaaaacactttgctgaacacgcagtctgagctgggggcctcttgaggaatgactgtgggacagttctccgccgaccatctcacatgtctcttctttgttttcatcaccattaatgtccaccatcagcacaaatgtgaaaattcagggaaaaaaacaaatgctttttgataaaagtaaatagttgtgatttccaattcagatatttttagagctgatgctatctgtaaaaaataataataataataatatagtctattttacatatcaggaaagtgaacatgtttcaatatagccatatatattgagaaggaacttaccaccccttcttccaatcgaggcatttcatttgttggttgaagcagatgagaactgtacagattgaaaatgatttgtttttttttttttttaaaaaaaacgaaaaccaattggtgcaactctccttgtaaccaaaggccctttctgccttctgtggtcatgtaggacctggcccttccttccttgtgtattttgtccaaccgtaaagtagcattttattgagtcacttttgaaggacgaattcagaagtatcattaagaacctaccttttcaggcttcatagccagagtcctatagagttcttatagaaacagaataattgaaattcagcatatactatgcttagaaagtattttgtttgggtttgattgggtttttttttcttttacttgtgtgtgtatgtactgggggagtatagcttttattctgtgctcaattcgaaagagagtattataagttttcccagcccatccacccgctaaaaaagaacatatccaaattttaatatgtatacacccaacctgtacctatgtacgtgaatatacatgcactgggaaatctacttaagagtcttcactgagaagttcactcgatagaaaggtcttgatagagaagagaagaggaaagcaatggtctgaaggcaaatcctgctttaacttggtggtccatttcccattcattcctgaaccaatgagagcagaaagaaacaagtcaacccaaacaagcaaactaggggctggacgcggcgaatggatgctggtcagtttggcaaattcactgaaactcatcaagaacccagctgaacttgcattccaacttccacaattatctgaaagggctagggaccaggtagccatgtgtcccaatcacacgggggagagtctgccaccggcggtgagagaggtggggaagctttggaggagacagtatattcacctttttatctttgggtaaaagaaaccaacaggactttggtgcagtagatttctcagtgccttctttaggaattctatcttaagcacacttcaaggggaaagaaaaaaggaggagagaacatttgttcccgtgaagtccctttctccaaaggactggggatcaagaaggaagaagagtaagaaggaaaaacaacaaaatcctgaggaggccatttcttttaacccacccagcttgcccctgaaaactgctggtgatacaaactttttcaaactgacttccagcttctccatgtgtcttggtaactgtagcctcgtctctgccctttctcctaataagatccatgtttctaaggagaaaaacaaaacagtattctcttctgtaaaactgtaatgtattgttgatatttgtaactattgtatatttctgtcttgctccagtcccagctggagtgtctagttccatggacaaggggatatttaaaattcaccacggacaagagccactaaagccaggtctctatcgctaatctctctcctattcttatttctctaccaactaatctcaagtaacaataccccaggctttttttcagcctcaattcaagtaactttgaatcaaaagagagcaaggcaaaaagcctccggacatgcttctttgggaaaggactttttctgtagctgcagagtgggcaggagggagaaggggctcccctgagaccccggcaggacaatggaaagcttccagccccgagctgatgtttcctcacctatcactgcttataggacagcatccaaatgctttcatgtcactcagcccaggcaacccaaaccagtcctggctacacccagaaataagagttacctctgcattttctgttgccatttttctggctctagaagtatctgatgcgcgactatgtcatagaatgtccacgcatctcagagtagtctatttttctgttcagataaaatatatatatatatgtatttttagcaaatttataatagggcaattgagtctaatttcttcttttgtaatacagaacaatatcttaggagtttcattgttggtcattatcgtagctgatgttttctggtcttttgcagttcctaccattgtcccttgggctgtttgggttttcttccttttgattctgatttcttgagggtggggaaagactttggggtttgacttccttgtgtaggcatttcttgacactaggcctggactctgtcaatgctgtgactttcctcattcatttctgtgtgtttctcccattcgttgttcttaagaatccagggcatgaatgcaggaatgagacccagggaagcagagctacagatggccctcaaaatcaggatgggatgtgggctggtttcacttatatcccacacccctttagggatctgaagggactgagttttctcatccccagagatcttggaaccaaaaatctcatgcaagcaaactcatcactggcatttctgagatccagaacacatgtgagtccctcctggctgggctgctcccacatgtccagcaccctgtcggcctgtaacatcaatcagagctgaaggtcagaggtttttcaggttctcgtgaacctcacaagaacatgctgggcctccgatctcaccaacttgtttatcagttccttgtttcgatctgtttatttatttatttttttgttattattattttgagacaaagtcttgctctgttgcccaggctgcagtgcaatggcgcaatctcggctcactgcaacctcctccacccaggttcaagtgattctcatgtctcagcctcctgagtaactgggattacaagagcgcaccatcacgcccagctaatttttgtatttttagtagaggcagagtttctccatgttggccaggctggtcttgaactcctgacctcaggtgatctgcctgcctcggcctcccagtgctaggattacaggtgtgagccaccactgcacccagtccatttcaatccatttctaacagcttcaccaaaaaacagtggccagacacccttgcagccaaaccctgagaagagatgtccccgaatctgctagctcatctccccttcccttgccagctgcctggctccatagagcaggaggtgtgtggcaaggacaggggcagttttccagcttccacctatccacgcctgggggagtttttggactgtcctgataattaattccagaggcagttttcagtcctgggtgggcggaggacatctcactaggcaggatcttcagcagaaagtgattctccatccgtcaactcatgcaggaagatgaagaaagcccagataatctccaacttgcattcgtttaggttttggtataccacccacctcactgtcagctgcagggcttggggctctgcctagaatcagaaatttgagccaaactgggaccctcagatggcagtgagccatcccatcagataactcccaagaggaagccaactcaaatatgaattttattattctggactatgaccctgatcagagttctcccaccccgaaaacctctgatagtctggtttgaaccagagtcaaataaaacagacaagatttttttttcctctgcacaaaagcaaaaaaacaaaacaaaaaaaagtctgccagtagtttcctgggtttgatgcccagataagcaaacactgttgcctatggctgttgctgttttcatcaagaaagaggttatatagtttgcatttccatccactctccctgattttatcttaacctagaatttctcctgaactaccccaaatgccaacttgaatttgggtagggctctgttaatcgagggaaccctcatcttcacttataaacctaattctctgttcctccctccaaagatcctgaaaagatctcctaaaggctggccaggatggggtggagtggggcagtgcacctgaagaaaaaaacttagctgccagctggctgtatgcaagttctccgaaaatttctattgtatgaaagggatggggtcaattgcagctcaaattaaggaagccctcctaacaggctgggttgtctgaccatggagctcaatgccatggtggacagtgagctcccttatatcacaggtgtttaaagagaggctggctagatggtgtaaaaaatgggcattgcagaggggccctagcattgcatggaaactgggctgaacaaccacagaaattcctctttgtttcttggagtgtgtgtgtgtgtgtgtgtgtgtgtgtgtgtgtgtgtgtgtgtaggtggtttcaacactctggatataagctcaagccactgaggcaaaggcatgcagcacaattagcaggaatgcaacttctgggctttggagctctcagagggggtgtccaagagacaagtctgcttccttccggctccgtcttggaacattttaatgactgtcagtcaccaatccaacccatccccagtggcctaccaggcaccacattgggatgagactcatgctacccttccccaggccagccaaggagcaatccacgctgtcccccatccctggctggctgtcttatggtgcttcagcccctccgcccagctcctgtgccctcatgagcctggggctttctgtataaaagatgcaatgatatctgttccccactagccatccccacaatgaacaacttcccaggcaatagcaaatggctccattccaaaagggcttgtttttttggtaaatcaaataagagaccccactcaagacctttgaaagtccccgtcaatgaaaaaaatccagaagggtcaaaagagaaaggcagcttttaatccagtttcacagcaaaaccaggctcttggctgcctccaagcagaatgccactctcctgcagctgtggcctccatcccaaatcatcctgcatactgcattctctaaggaaagcatttgacaagagagggtttatgtatggtggattgggagaaagtgagacttcaacctcagggtgaaccgaagactggtttgtctttggttgttttagtatgaggttgggcaggatgatatgtttggatgggtagaatgagcagccgccttcctctgaaaccaaaataaaataaaaaccagttttcaagattcctcccaactcctcactggaggctctgccctgcagaatcactcaagttgcaacaacacaaggagacaaaaataggatatttcatgaaaatataagaaactcccaattccgtcccattaggatgccctcaaggggccatgcagggatcttcccatacttcctgcttccctgatctgaaccaagattggaaagaggcaggcagcagagaagatgcccaagaaactctgacatatccacagcttggctctgccccttgggcttcactggggtttgggcctccctcttggttgagctgagtg

SEQ ID NO: 12389 - DNA, 84409 bp, Homo sapiens
  misc_feature (1)...(84409): n = A,T,C or G, or insertion/deletion polymorphism (see Tables 1-2)
cagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagaggaccctctaacagtggagaaggacaaatggccactcatgccccaatatttttaataataaatacattcatttgttggggatgggagcttttttcctcagcttctcccaatttgattttaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaccttaactttataattcactgtaatatgtcagaatgattacatgcaatgcctgcctcctttttacaatgtcttttgcaatgtcttcttttctactctgaagtaaaatacacagataacaaatattctaattaaaatataaagtaggaataaaatgaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatggtgaacaactccggtaaagagtctgaaaacctgtgataattgtcctttgattcatatggcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctatttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggtcatattgcaccctttgaaaactatcgttagattatcaagtgttaatgccaagaattttgtaactacctcttgtcacctagaagaggttgcagcaacttagagggtataacaggtattcagtacataaagcatgaacaataacttagtgtgggtgcaaaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagantataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggagtcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagcaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgtaattmaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccaggcaggcctcaggtcagtggtaacggacgactgcttccgtggtgttggcaggtggaaatggagggatacagctttgtccggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatsatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtcatattttaatcatataaaatctaaacctacagtttgggtttctactgtgatattgggttctttttagaaaattgattctgaggaatgatattagggtagattaacttgtgaacaaatagttatcacaacaggatatttttgaagagaccaataattatttcattaactttacttattgatcatatttataaaactgtggacttctgaaatacaataaagatactrgtattctactagaagtctgaagatatgagagatctactttttttgtaatgtgagaaatagatattgaatatgcctttcaaattagtttttgtattttatttccagtttgaatctttctgtaacttcctttaagaaaattgtctacagagagtatgaaccatattttaagaaagaaaaaccacartctaccatttcaggtaagcctgaaatatacttttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcattaaaccaagccaggggccctttggggcatggggccctgtgaaactgcccaggtcacatacccatgaagctggctctgtttttaaccttgattaaaataactaaataaaacttataagtgtttgaatttttattcattcatctaaaaaactgttattgagtacctggtatgggctgggcattgaaataggcattgtggatgcaatagtggacaagacagtctcatatcctgggttcatggagattatggtctagtttaatgagcatagatgtgccttcgcaaaatgatattttgcttccatttggctccctagattcattcaaaggaactatgtatggctgactcttttgcatctctttcccgtctattcttctgtttatttagtgtgatatatacaatagccataatttttaaagaaaatctcttattttttcctcatctcttcctttatcaagaagactgggttgaatagggttctaatatcttaactatgataccatattccgcagggatgatagagaccatcaagggagaacttcctccagttgaatccccttgtcagtaattcacctgtccctttccccaatcagatgaagacctgctgtctttcccagaatcatcctagtctgtcctgcctcttctgatctcctttaatcttcaatatttagtcaatgggagtcttcctttcagttaaaaatcaacgactaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttcttcgcctatattccttccctaatctgctttagtatgaataagtctactaaaattactctcacaaaagggcacctaggacttgaggtgccagagcctatgttcttttactactagacattactaggacatttaacactcttcctttctgaagctctcgctttacctgttttttctagtgccacttccccttggttttctcagacttctcttaccactcctgctcagtatccccaccagatattcttccccagggttcgaatctcacccaaaaccaaggctttcactactacctacccagaagccactttccctctgaagctacattgacaccccctcaataccagcagaattaaatcttccctcttctatacatccccagtaccttgaattaatccctaccttctaaagatattaagaggatcaattgagttaataagtacaaagtatttataatgatgctgacacataataggcactcagtagaagttagctacattattgttattgttgctgctattactaatcataacttagatcatatatatcatagtattatggatatctatatatctatatttctccactcatttatatagtcttcacatgtgttcatttatatatttatttaattttaaacagatctgcatttaaatattcttttatttttaaataattgtgtattgaggccaggcgtggtggctcatgcactttgggaggccaaggcagatggatcacttgaggtcaggagttccagaccagcctggcccacatggtgaaacccmgcctctactgaaaatacaaaaattagttgtgcatgrtggtacatgcctgtagtcccagctactcrggaggctgagacatgagaatcacttgaacccaggaggtggaggctgcagtgagctgacatcgcatcacttcactccaacctgggtgacagagcgaaactctatctcaaaaaaaaaamaacaacaacaacaacaacaaaaaagtatattgagaacctactacattctaggctctgggataaagtgaataagacatggaccttgatttccaggagccaatcagctattggggataacctatggatagacaagcaatgacagtagagtaataaggaagaactatgatgaggattctgtagtaggacataggagacctatctccagtctggtggtcaggaaagtatttctatttctagattgatagctgaaaaaagagtaggatcttggaaagccaagtggggaggcaaggggttgggtgatagatgcattttaaaccaaggcacagaatgtttaaaagtttggaggtgagagtatggtatatttgtggaaccataactggatcagcacagttggaccacaaacttcagggaaggaattaacaagagatgcaactagatggggatcagggatccatgctaggctttatattgagaggaatagggagtccctaaaaggatttcagcaggagaaatatttgtcctttagaaagattatgttgtccaattatagagaatagattggagaaagaccagtccagagccagagaaagtagtcatgggactgttgtatcaatccagatagcagagaagctgagatggagtccaaagatatttaggagctaaagttgattaaacttggtgactcattagatgcagataatgaggaagaaaagggaattgttatggacttcaaggtgtctggtttgaacagcagaatggatagggtgccattcagtgagaaagaaaatgtaagaaaaggagatagtttgtgagagaaggtgataagtatagatttggagtctgaggtgtgtatagaatatctacctagagatgttaagtgagcagacgggtgtagaagtttggccctcaaaagagagatctgagctagctgtcaacatttgggagacatcagaacaaagatggcaaatgaagaatttagagggtgtgaactcacccagggaggatgtgatgagaagagaaggctgcagacagagctcaaagtagcagcaaagtccaagggatgagccaagaaagaaaagtttaccaaggagcttgagaaagcctgttcagggaggggagaagaaatctagagaatgtgttatcctggaggcaaagggtcaaatgctattaatataagggtcaaaatatggtccctttgttatggaatagtgggacaagaccagatggcagggtgttgaggagtgaatggaaggcgaggaaactgaagcacaagggtcttatagataactcttccctgaaacttggttccagatgggaggagagacagggtagtttcgggggtgggggtgggtactgaggagcttaaggacatttgagaattttataaaaaggaatacagagacttaaatatttaagggaagactctatagaaatgccatgaagtcctttccaatagaaaatgtggggataaaacatctgagagagaatgattaatggagacttagaagaagcaggaagcattgggattcaaaccttgggctggcttggccttaggtagaatggctaccaccttcatggggggccaggaaagcagaggataacgttgcaaataaaattaagtttgtagttatgagtaggaagttgaaggatgtcctgtcctatatcacagagtctattcattttcatagctccagctccaagcttagcatgtacaatagatacttaagaactatttaattaaattaaattgtaggtagatgaagggaatataaggtgggaaacatactcattagggccaggaaaagaggattggggccggtatttgaaggtgtaccttttgtggcttttgccaagctaagcaaattttaatccctttgctgtgtgagacattgtgctaaatgccataagagacggaaaggactaattccaggctgaagacttttaaacaataaaaaggcatggatagcttttgaagaaaagggttctgtgatcaaagtcctttcagatgattaaattttttagtgatttcctgatttaaccttgttagaggtagactctgacagttggtgagaacagtctccaatttatgtgtgaggcctttgcacctttctgtcaacccctgtgtatctcagaatatatttgtttcatgtggacaaaggtgtttcgacgtccattttaatgtaatctcttcctgaatgtccaaagttgcttaactatgaacttatgaagtgcaggagtggtatcttattcacctttgtaactctatagtagttgatacaaggaggcaaatctggcgtgaaggaaaagccttttattttgactgagaagatctggatttgaacactgccattaactatgtggcctctcccattccccagactagtcctgtgttatttgtacctttcccctatgtcctgctccactcatctgctgggtgtgattctagctgagccctgaaaaagtcatgagcctcactcctgcagcatgaactattgttgttgttagttcttgtaattgtagggggctgggctgtaggattggaggtatgaagatgcccatccaataaggtttgtggacatttgggcaggtgagggagtacagctggggtcatttttaggaattctgtcttgggctttaaaatggctagtcttggctgggcatagtggctcatgactgtaatcccagcactttgggakgccraggtrggaggattgcttgaggccaggagttttagaccagcctgggcaatgtagtgagactctgtttctatttaaaaaaatacatacatatatatatatrtatatatatatatatatatatatatttaaattagccagacatggtggtacatacctgtcatttcagctactggggaggctaaggcaagagggtcatttaggacaagagcatcacttgagcccaggagttggaggctgcagtgagttatgatcacaccactgcactccagcctgggtgacaaaataagacctcatctctaaataaataaataattaattaaattggctagttttgagtctgcatatttttcagggacaaattataaaatgtttgtccctgaaggagttttgaaatagctgcaacaatcactaccttgtgttatgtaatgcattgttcacctaagagcaggggattggattagttgaccttctgcagtcctttccagttccacaactgcactaaattgggtacatgctgtgctggcttccccaagccctgaagtaggccactcctttccccaatccagctttgggcactgaggagagggttagaagggttttaggccatctggctgttggaggagctaaagagcagcttgaaaaccatttagccatgtgttttcctacatgcgtgaaagtatttggtatgcatttatgaaaacatccttttgttttgccttaaatctgaagaagcaggaggggaggttgaataaatactccaaactgtccactgaagtaataggtcttattaggttaaataacttaggagactttctctgggcatctggtatttgcaggcatgtgatgccaacaaacaaatcaaccaagcaagagaaccatggcaactaaatgcggcacacaattggcagcatagtcagcaccctgttgggctcattggcagctggggtaggtgggaatagtcagtggaaacttccatcaggagccaagacagagggtagcagctggaagaggggggtcagtcagtggagtccgacatgtcaggagtcaaaagaggtgtagacatctggactattctataaagatgggggyctgagcctgcccygtggaaggaatagggagagctttggctcaggagtccagagatctgagttctgatcccagcaatgctaccagatcactgactgaccttgggcaagtcacctttgtcccccgattcctacctcccaggctttgttaactaaaataaggactgaactttgtgacctccacagtcctgtgtaaagctaacataaaaacaaacaaaaagcttcaggcacaagatcagaataaactccagsagtaggagttcaaggaaaggaataggacaaccgtgggtggcaagacaggggtagggaaagataggacctctgtcccagaaatcagagtttaccattgcttctgtaaccagttactgcaaacttagtggctaaaacaacacaaatttattcttttatgattatatwtctgcagaysagaagtccaaaatgggttttattgggctaaaatcaaggtgttggcagagctgcattccttctggaggctctgggggagaattgtttccttgtcttttccagttactggaagctgcctacactcacgggctcatggccccttcctccatcttcaaaaccagctgagtagcatcttccaagctcttcctaactcagattctcctgcatccctctgataaggacctttgttattacatgggatccacctggacagcccagaagaatctcatctcaagattcttaatmatagatacacagtcccttttgccatataaagtagcatatttccaggtcccagagattaggacrtggacatctcagcagggrcacattattctgcctactacacccaccaaacaaagccctcccacggtgtcctccatctcagagaatggcaccctcctccacccagctccccaaaycagaacctcatcagccatccacagcaactgatgtcctttattctctaccccacatccaatccatcttcaagttccaactattttatctcataaatacatcactaatatattctctcctcatcatctcatcataatctcagtcaccaccatctctcctggagtcttctatctgttctctcaattgttctctgctcagtctcctccgagatcatcctccacaaatacagccagagattttaaaaccaaaatctggtccatgttgcacccctgatgaaaactctttaatggcttccagatactcttaggctaaagggaaaactctatgaggcttacaaagccctgcatgatgggactctgaggatgccttcggcttcaccttctgccccttcctttcacatactaagctccacctccccactggataactgtcagttctctaaaaaggccacattttctggcacctcagggcctttgcgcacrctactctaactttttagaatgtctttggccatcccttttcctctctgcctttggacctcagttaaaggattaattcctcgggaarggattccccaactcacctccaattggactagattccactgtcaaatactcttcagagtattccctccttttctgtcataatatttaccataggtttaaattgaatgtttttgtgatcatttgtttaaaatctgtctttcctactataaaaacgtataaagttatagaactataaaaatgtttgacttttataaactctatgaaggcagggagtgggtgtatctattttactcttttacgcaccattgcaattctgatgcctaggataatataggcacttgatattcattgaataaataaaggaatgaataaaggaatgaatacaaggtggaggtgtagtataawgaagtggcttaaaagtcacgatctagagacagacatattaaactttaaatcatgatgctgtgtgatattaggcaagatatttaaactctctgaggctcagtgtcctcacctataaaatgaggatcttaatatctaccttaaaaacttgtgaggattaatgtagggacttacagtgcttgaatgtattaagggaaacagtacaggaaagccttattatgattatcatcaccactgcaaacaaatgctggctgaactccatgagtgcygtgacttccttctcctgcttctaggaygcctaatggcgagaagccaatcccatgacacttgtggatggctcagaaatgacagtagttgatttctgtcacttgtctggaatggggcttttggtcatagattctcaagatttcaaagacatcaagatcaccaaggagcacacgttaaagtccagattcccaagtttcacctccagaactcagattcattgaggctgaggtgatatttggaaatctgcctcttattaagaccctaggtgattctgatgcagagactccaaggactacactttggaaattctagtacagtcatcccttggtatccacagggtattggttccaggactactcacagataccaaaatttgcagatgctcaagtcccttatataaaatttcatagtatttgcaataacctatgcacatcctctcatatactttaaatcatctttaaattagttataatactgaatgcaatgtaaatactatgtaaattgctattatgttakagttttatttgtattgtttttattgtttattttttattgttgttttttgaatatttttgatccaaaattggttgactccatggatgtgtaaccatgaatatgaaccatggtcatggagggctgactatatayaattcctcaaattctgactcagccatcaactttttccctaactccccagacagaatttgtgcttcatcctctcttcttctgtaatattttgcccatatctcagcagtcrctcctatcatacatctatctccaaactagcttgtgagttccttcagtacagggactgtatttgatccaggtagccagaaactttctaacacagtgcctggcatgtagaaagtaaaacctcattcttgatttctgcacccataacctcctgtctctgctgtgttctcccattgcagtaactaataacatcatttacccagttgttctgataaaacaccttgaggtcatccttgacttctgtctctcacaagccacatgcaatccatcagcaagtcttgtttgccttacctacaaaaatgtccagactccaaccactactcatcacgttctgctacatgtgctggcccagtacactgcagtctctttcctatactgcctaatctctctgcttccattcttgtccctacacagactattctctacacagcagctatgatgaactttttgttttaggatgaacttttaatacacgttatactatgtctctgctgtacaaagtggtttttcattttacttagaaatgctccatttcacttagacgaggcgtggtggctcacacctgtaatcccagcactttgggaggctgaggcgggtgtatcacctgaggtcaggagtttgagaccagcctggccaacatggtgaaaagtcatctctactaaaaatacaaaaattagctgggtgtggtggtgcatgcctgcaatcccagctacttgggaggttgaggtaggagaattgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccrtagcccatagggcctcccttgttctacacacctaccatccacctcatctcttctttcttcccgtactgtttttcttactgttccttagatacatcaagactactcctgcctcagagccagagagctgtgtgatttggttcctcaattcatctaggtctctgagcacacccatgtcagagaaatctaaagtaactaccctctcgcatcaccctctgtaattgaaatgaacatctttcttaagcaaagaaagttattgctaaggaatgacagtgggtcaaagtgggcaagacttggccagaactatttctcctactctgttgacttcttttgggtccaggacaagtgtttctaccattctattgtgatctgtgtacatgtaatgttgagttaatgagctgctaaaaccttctagattgaaaataagtgagtcagcctcaggaccaggaggaatggtagcaatcactcttggtatcatctgtttgtttttcttgcttagcaactctgcctttgatgaccctgaatacagacatagtttaaatatttgttttcacaggacttcttgggcctactttatatgctgaagtcggagacatcataaaagttcactttaaaaataaggcasataagcccttgagcatccatcctcaaggaattaggtacagtaaattatcagaaggtaagataaatctaatatttttctgaaaagggaaaatgtctaagtctttaataccagcatcaacatttaaaactatactgttaaccacgtgttgttagggaaatctcttgcaactggtaattataaaaattgttgctgttgtaagttttgagagaagaaaaggaaaaggttttggagtcctctagacctgcatttttcactgggttcttactctttaatgtttgggagggcaagttatctaatttctctgaattctcatatgttcatcttaaaatgggaataataatacatacattgaaagatggtttaaggcgggggtcagtaaatttttccgtaaagggccagatagtaagtttgtttggctttgcaggccataagatctctgttgcaagtactcaactctgccttttagtacaaaagcagccatagacgatacctatttttttggctttggttacagatgccagaactaattaactttgttaccgtattctttccctcaagtcatacaccagagtaagaccgcctctgacaatacaattttatttacaaaaacaggaaattggttgggtttggcccatgagccactgacatagtgacatagaactagcctgatataggcttcctggcacatagatgacactcaataagtggtatttggtggtggtgagactagaagcattaatagtattagacttttggacatagtgaagtggttaagaaagtaagctttaaaggcagacaagttaaaattctagctttatcatttctgattctacgactttagcatctctgagcctcagttttctcatctataaaatggaaatgattataaccacccataagattgcctgaaatttaaatgaagtcacttaggtagagtactaaacatggttcctgggatcggataagctctctataaataatgatgacaatgatggcaataatcataaagataatagtcatgcaagttattgtatcagccgctgaatagtaagtacctgatgttaatatggttctaattatcccattatgmygatgttcagatcattgtaagcatagtagagttccatcaggcactggtataaaaaattgtatccatattataatagttgttggtatgakaacattttaaaataatttcagacttttcatggttcacatttaaatatctttccttctacatgttccagccatcatacctttgagagaataattgagtaggagagtggtttatgtgcaggttttagaactagactaataagtgcaaatcctggctcagtgacttttatgaagttatttaacctctgtgtgcctcatctttctcatctgtaaaatggtaataataatcatgtctctgtcatacaggtttgttgtcrtgaaatcttagaataatgactggcatataacagataataaatattagccatgatagtaaagataattcttcaattaaaatgtgttcaaataatttagtatttatcttaaaacttgttagtttcagaaaaaatcagaaagtaatttttaaatttattgttttctatataaactgttgtcaaactcatacccactaaggtataagtgactgataataggtcaatgaactaccttccttaggagtacttgcattagcacttaatctttggcttgaggaaaaacaatgaagcattaactgtggcactgagatttcttccaaagtgaatttggcaagactctgggtgaggtagtgggaacaggagtttctcctatgttcttaaaatcatacagtgacatagtgaacaaccacttcacctacttatgaggcttctagacgactgcatcagaagttcagcaatgtaaagaagaagggggagaaacctcaaaatatcaaaatgtcacatgcaggtttcatttcaaataagggaggaggtaagaattgtagactttggaccctacctgggctgtttgcacagtgaatgaaccttgcaacactatccctcttcctttactgtttatttgtccctacattccctacagccagcaattatttatgagcaattgcttaaaatgctcccacagctttcactggagacatgattattggcatataatattgcctctggtcctatgamtctaagaaaggtaaatacatattggtagggaaagtaaaattttaccttggaaatgagatgcaaayctagtaagcagatagtatcttttatggtaaaagacaagccttataagttgattttattatgccctctgcattaaaataaaacatctcctcctccatgtctgacactcaccctcacctatagcctccctctgtggtttgagctatttttttgggagtggggataaactaactgcatgctgagccagttacatgagaatccagattcctctatctcagaggtagatatttgagagataggtggtagggggttaagatagtattacactggcttgagaaaccacaacagaacataagagaactctggataaccctttttgacagaatggacaaacggtgatttgtaaaaatgcttgtaaggacatttcctttaataatgtatttaataagactgtcttagatcagggaataaagtatctgcaactgtaactaatcacttaaaarctgtcactaaagggtttcaatttgaggttaaattttcagaaactctgtaactagcatgcatcaaattgacttcaatgctgcacctttgagcaaagtttgttgttcagtaaaattttcaaagtcgttttggtcaattacctttaaaaagcttgtttcatggagaatttaatattattcttttcttttagttatattctcatattttaaatatatgagttgcatatgaatgtgatgtcacmaaattasttctataatatatagccatctgctggtaagccagctctccaaataaaacacrttttctgccagacattgttcgttgtatctaagtgttgccaaattctctatacaaaaatttgctcttctagatttttccaaaacattccaatgcttgacttaatgtaggtgattacattttttcacttctcatctgaatattttggccttatgtagagacttccttgagtatatgataaacacctgaaacaaactataacggctatagtttgtatatttaataaatcacaaaaatgtggatcccttttccaaagagacttgcaagtcctgtgcaatgaaatcagctctttataaaacrtcagcattgattcgcccattgcctacattatagcttctaaaagaatattctgaatctttgaatgtagtgaagcattcactaagtttattaacttaggagaggaaaagagttgttcacaaaaataagtaacaagggaagagttactgagtgagcaccctaatgagtaaccaaaaaggctctttatgtaacttcactttcccaaagcttgtatgcaccatttttcatttttaaaaaatactgagagcctttggcaagtaattagtacatcatgacaagaataaatacaatacaaagctgactatcgactgagcaggaaatgaacagaactgagtaaatataaatgaagagctacccttgtgtaaagattttattccagcaagcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagytgtttgtattttatactttatattaatgtatgttgyaaaatcaaagatacaacaaacctgttttattctagactaaaggtaaaataatttgaagtgaaaagaataaaagcattgataaaattacaccccaattgtctcattagccatctcactcagtgtaattatagaatatatcctatgtacaagtctatatcattcactgtttcaagatgctcataattcaacttttagtagtatactaaacttaattaacatcattcatttaattatttgaaattcatcttatatgtaactgacaggcgaatgtgaaattctgagtaatttagtttgatcaattagacagacattaatttgtgtgactagagtaacctttcattatctatctcaaaatatcatgtacacaagtatatacaataattttttaagcccagtatgtgttaaaataaatctaggtgtgaaacattgattgtttacagataggttcaatattgttagaaaatcagtcaccctgctatacctagcacaagtgttatagcatcttgggcaatttttagatacttacattggttggttctcattccagattgacagtgtgttctaattgtagccctagaagaaatctagaggtcaaacctatcacaattagggcaccaacatgtaccctagagttaactaggcagagcccctcaggggcccaggccctktcttctttacatttgtactctggcatttagcacagagcctggaacctagtggatgatgatggtcatgatcatgatgatattaatcattactgaactaaactgaggggccgaggactgattagaaagtaaggactatgcattatttttcccttgctttaaaattattgattttgctgataattttgagcaggtactttgtcttacttattaccaaaaaaaaaaaaaaaaagtacttttaccaaaaaagtcttatttactttcatcgcctttggaatagatacatcactacaatggattggaagtttgtgtcctccaaaaattcacatactgaaatctaacctccagtgtgatggcattagyaggtggggcctttgggagatttttttttattatactttaagttttagggtacatgtgcacattgtgcaggttagttacatatgtatacatgtgccatgctggtgcgctgcacccactaactcgtcatctagcattaggtatatctcccaatgctatccctcccccctcctttgggagatttttaggtaatgaggatggagccctcatgatgagattagtgcccttataaaagggaccctctcactcaccctctttctaccatgtgaggatacaaggagaagatggcagtctacaacctggaagagaccctgcaccagaacccaaccatgctggcaccctgattttaaacttccagcctccagaactgtgaggaagaagtgtccgttgtttataagccactcaatccagggtactttgttaacagcaacccaaactaagaaaatcaccaatttctatcttactcacatgtgttaccagaactcragcacacttaagatctatcttatctaaagtagaacataaaggaaagaggctgtattaattgcaacatgactgggaaagaaaatacttaaccaaaatgtgaacatgtattcccacaggctatcagagcatttgttaggagccagaaattttacaaatattttccagtcttcataacccatcaaaaaggataaagttatctctagaaaaaggattatattatcttaaattataaatgaaaaaactgaggttaaagggacttcaagaaaccttcccaagttcccacagttagcaaatgatacaaccaccaagatattttcaactctgaccctgaagttcaagtgctttctcccactatctagcagaaaaaagtatcgttaaccatatagtctcacaaatactgaattacaaatggcgatgagtgctgtcaaaaaaccaacaacaaacaaacaggtatcacaatcagagatcaagaagggtgtaagatgatatttgatctgacatctgaagaatgagcacacatttacccagaaaaataaagggaggaagaacttcaaaagttatctcctaccctgcaaagaatataatgttttgcccttaggggagcttgtgaaggcagtggaaagaatatcattttctactatagaaaccccatgtgatgttttaacagttgaaacagtggaagctgcctgtccagaaacatcatttttcaactttatgaggccatgtagcaagaagcattgaagaagggctgtcatgcttgattcaaggtagatggtgcagctcatcaactagccatgctaatttcagttaatagacaagttctgacctgagagggcaactctccttatcagtcctgtttgtgctttgttaccaaagctcttttgtaatctttcacagataatgcttcctgcttattagtggagactttctccataaactttttttcttttatagactagaattatgttatmacttacaggaagtgacttaagcttttatcatttctcagctcttgacagttttattatcaaagtgaaagtacagcctagagtaaatattagttattagtgtcaagctatcctttggggtgtgttgggggaagacacaacaaagtccactttatgctagygcaaagttcacaaactcagatgcctatagtagccagataagtagttcagtgaacaaaattggtccagtaagdactgatcatcagaaagcagaaaagggcagctaagatccagatccaacaaaattctgtgcaggagtttggtcctgttgytaaccagatctccaggtttttgttttttaaagagaaaccagtaatccaaattcttatataatttctccggatgtttaatgttggcatttaatctattttaacattacgcaatcataacaacacacagccatgagctttgacttgttgacctaggctgtagcccataggaccttaaattttaggagtttaataaatattcactgagcatcttcttcatgttcatgttccatgcttctctaggtacctatggaaggcaccagagacactaagacaaatacaatccagcacttttccttgaggaactcacacttgggtgaccaaaatgtgcaggacacaaatacttatgatctagtagaagaaaatgaattagtcayataatctcacaggcatttaattacaaattgtgatgggtgctgtaaaagaaaaaaatgtgtatcagaattggagataaaggtagaagtgaacagatattcaaggtgatgtctgaatgatgagcacatatttatcaaaaggaagacgggaggaagagcactctaggcagagggaatggcatctgcaaagaccctgaggtaggacagaacttggatgtctggggaactgacaggggacccaagggacaaggagcccatagtaaacaagagaaaagacgtatgataagactgaagagagaagtagaggtaaatcatacatggacttgtggtccacgttaaggactttatgcaagaagtaaatctagatrtacctactcaacttatggtttccatgctcagaacctcatgagatacattgcacgttactgtagtacctgaatccttcattgctattgaatggatgtgccttattttccactcccacctggrgaatccaaacatatgctgatgccatgcaaactcatgcaaagcgttttgagtggaatagattttccacagttgggatggggaaaggtacaattaaagaagggaagctgacattgctgtaatgtaaaaaaatattttatatggaaatttagcatctcagactttggcttcagaacataaggaacmagatttaccctttttctcaacaactagacaggcagacaaaacatataaaacagaagttttcagacatcgaatgacagacaactcaagacagtaaaagaagwgtaacaaaccagatgtgccctatgagcacctaarcttactgcttgaagagtgtttccagggaacagcacaagcagggagaacccagacagagtctctatgggttgaggaaatagagtttggacttcggagaagctcaaatggctagaatttgtgattttagggcagagtcctgcagaggacagtataatcacagagaaagagctctagagaatctacagagaggttttgtcaagttgaatactgatctgcacatacatgtgaggaaagtactgagggtaagaaaaatgtcacttgaaaggaacaggtggaacagtccctggaccttactcagggccggtaatcgtttatgttcctaccatcaaacatagaaagacctcctaataaatgagcactggatagaattgtcagaaggatttagaaacagtgggtggataaaattagactacaggctgctgaggaggcaacagaataaaaaacaagatttgatttcaagtatcttaactgtgaataaaactcaatactagttaacaagaatgcaacaaacaacaatgtaaattcacaatgttaataaaaataaacaagcattagaagaagcagaaagagatgactcataaccaagaaaaaactcaacagattgagaagtgaaagagagaatagaagcagcaggcagagacagtaagacagctatcataaatcttctcaatatgttccagaaagcagagaaaagcatgagcatgatgaagatagagaatataaatatgcatacacagaacttctgtagatgaatacaattgttgacatgaaaagtaaaaaataaagcatagaaaagaaaggtaaaaaataaaggataaaaaaatatattataaactgaaggataccactaatacaacaaacactggatgaaattaatagcacattagacactgtgaaaggaaatagtagaaaatattaatacattgcaatagaaactgcaaagtgaaatacagagattaaaaaggctgaagaaagtgaacagagcatcagtgaactgtgggaccatatcaagtgatctaacatatgtgtaattggatcccagaagtagcaggaacagaaaaagtatttgaagaaatratgactgaaaaattcccaaatgtaatgtaaactacaaaccaacagattcaagatgtttgacaaaactaagaagaaggaacatgaagaaaaccacaccaagccacatcactatcaagttgctggaaaccagtgataaagagaaaatattggaagcagtgagagataaaaacacacaccacatacaggggaacaaaaccaagaaatgatagcagacttatcgttagaaactatgcacaccagaagacaattagggacatctttaaagtgttgggagggtagaagataggggaatctgtctgtttagtattctataccaagtcaaaaagtcttttttaaatgaaggcaaaataaagagtgttttagacatacaaatgcagaaagaatttctcactaacagagcagaaaaaaatgttaaaggaactcctttagatagaagaaatattatgtcagagagacatttagattcataagaargaatgaaaagttccagaagttgataaatatagagaaattttttcctcrttttaatctattaaaaaggcaattgattatctaaatgttaaagcaaaatagtaacaatttattgtggggtatattatgtatatataaataaaatgtatgacaatagcacaaaggctgggagggaagaaatggaaatatattattgcaaggttcttacaagtgaaatagtataatattatttgaaggaagtttgtgacaagttaaaaatgtactatatattgtaaacggaagggcaccactaagaaaacaaagctaagaaggcaacaatggagattaaacatcactaactatactcaatccaaaagaaaacagaaaggaaggggaaaaggaataaagaccagatagacaaatagaaaataaatataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagraaattatataccataccagctaacactaatccaacacaaaagggtgtgtaatgatgattccattgatatgacattacagaaaagccaaattatagtgaaataaagcagattagtggttgtctgggcccrgagggcattggctacaaatggcatgaagaaatgttttggaatgatggaactcttctctatcttgattggaactatagctataagactgggtaattgttttaatcaaagctcagcaaatattatacttaaaagtggtaaatgttattatatgcaaattatacctcaatgaggataatgaaaggaagaaagagagggaaggagggtggggaatagggaaggaagaagacaaagaaaggaagaaaggagaaaagaaaagaaactaggaaaggaaaaagaaaagaaagggaagagaaaggaaggggagggraaggattaatcatttcagttttcaaaaagtgtagttgcttcagtaagagkagttttattggccttttaccccatcatgtaaaacatttcaggcttttttycccagatccttgttgtctgcctacatccacactgatgttctcaccttcttctcktaaagaatttatcaagttattgtaccaaacaaaaataactgcatcccaaagagaaattctgtcaccagctgatgatagggaatctttcacctaattaaatgaggaattcctcaggcagaggaaactgttcattccacttggctmtctatggcactcacctctccccttcctgacctcacttgctccattttattattgaaaacctcacccaaccctctacacttcttttaatattgagtatctcagttccttctcttcaataaagaagaccaatttcttcatcctctccctctcctatcagtagggaaagtccaatatacatggaggtgttaatgatgtgtctttgggtgcacaaagtacaaagtaagacatctaagtttcaggggatggacacrtttcatattcatacagacaaccagcctgcataggggagttagacgctgtggctcgggggaaaaaattgagataatcagatggctaagatgaaataaagagataaaacaaagctgaggatcacagcagttggaaagaagatctgaaatagcaaaacaaaataatacataaacagctctgactatcctcccatctcatgttaataggctaagtatgtcttattaaasaccacaaagaagatatcacccattcttatattctgagatggtttactaatcaaaggcgattcaattctctgattatatttaaataataattgttcaggtaccctggaaaattaacttgctaaactttaatttacaaataacatttgttattcttaagatcaccatgttatcaaagcctttgtaagtacatgagcatagaaatgggcatatgtgaatctttccaaataataaaagttcactattgaaggacatatgcatctccagagarctcatcttagctatcmccagatktgagagtggtgaaaacgcaatcctcagaaactgcccacatgtcttgatggctgttactcctccaggtgcttcttaccttgaccacacattccctgcrgagaagatggacgacgctgtggctccaggccgagaatacacctatgaatggagtatcagtgaggacagtggacccacccatgatgaccctccatgcctcacacacatctattactcccatgaaaatctgatcgaggatttcaactckgggctgattggscccctgcttatctgtaaaaaaggtaagaacacccccaccaaaagattcaacaactaaaygttggaatggtcaggagttctgtcatgggacaaagcttgggagcatcttggtaacttcttgtacatcaagcagaggaagacggcacggagaccagatcattgtttgacaagagaaaaaaacacctgctatttcagggtgtggatccacctctgtttcttctcattcctccttcatctcagtccttaaggttctcccaggcaaattcctgtttgagagtatgttctgatgtcatgcttgtatgatctgtaacatttacctcaaggccaaagtcttttagaaagtatacagtagcctatactctgctgaaagagctcttggaaagaactttggctaacatgtttgacatatctgaggtttgggctggtaatttgctctataaacacgtgaaatgccagcttcctttcttacaaacaagttgaaaactttgggtggtaggtttcaaacacactcaagtgactttacaagaacttttattggctgggcttcttaggagcaagcttggattttcattttatcccatgagaatccagcccatctttcattaaaacaaacaaccacagtgagccacagcatgggaaataacgtgatggactcaccatctgcctatacayacacgctcagrccatacctacatacatgcccaatgtatttactcattatacaaagactttttttccatttcctggtatatataagatactgtgatggtactgaaaaaaaccktaaaacttacaaaagactcttcttgcattttaccatcagcagcatgtttttctcatagtgagaatggattaatgctgatacttccacccaattatctaatgccccctttcatatacaaataagatgacagcattaaacttggggcatgatgctttyaccaactgagctaacgtatctatatactcttctattgagactggrggaaatggatacttgtacagagtcttgagagtcaccaaatgttttcttcccaagctggatgaaataaagcctgttccccaaagcaagaaggtatcaaagaagacagtrtggcaccagattttaaataaccctagaaccattattacttgataaatatgctattttaaaaaataagaatttcttcaagttgaaatcattatggttgattgcttgccctaaactctttgctatccaggaaagctaatgagcrtcttctatctgcagtgctactgaaaacatgtctttcctttcatagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccaggtaacaygagggctgtgtaccattaaacaacagtaaaatcattagtaatttttcggtcctgttttcttcaaagcactagagaagttgaccatactcactgttttscaactccctatcaagaaggaaatattttctctttttttttttaaacaggaaatagaagagacaaattagaagctagagaagaaatgtgcagccttgttaggtatagtgacctgagtaggtttcaccttggcctgtactttgaataagaccttaaggtatcagctcagccactctctccgagttctgcagttcctctatatgatgaccatggcttcttcaaggacaagccctagcaggaaggatcagcaggaagattgcagtaaagatgaacagattaggagtaatcctcaacacacaaaaaaaaccagcatttcaaaaggtgacagaagagtaatattcartggcatctagaatattttctctttccatttgcatttgggcacttatgagaaggcaaaatcatagcaatcgttaagagaaaaaataactrattcccacttagaccacatctcttctatttctctctggtagaactgacctacaactaaagatccagggtatatgatactagcctgagggaaaaacattaaaaaattaaaatgccactttactaaataaaccatatttcaaaacactaaacttcttagaggttattctctaatgccatctgaaaatcacaaatagcttcacttactaaaacacaaatattgttaagagttgagatctgggtagtgtttttaaattgtattctatttcatttgactacattttccacttggttttctgaaaatatactcatatgactctcaatgttgatcccaagttccaatactaggagcttgtaaaaactggggcttagttaactgacctcgaccttagataatctgagttcagacttcagattatcagactaccttctgtggccctggataaattagttgtctcaatgtgcttacttacaaaagtggactaaccatttatcctaacatctatttcctggcagagtgaacaatctgtataagtatatggatgccaagaaaagcaaaaccatatgcacaaaaataaaaataaattgatctgagcttagagtttacgaatttatagttcccaaaagaataaytgggggtaaatgggacaaggtagggaaagaccatcagtagaaactaagaatagtaaacatttgtaaaaaccctctgccttataaagcagaataaattgaatacatatgataaatgctaacacagatatgttaattgctgaactcaatataagcatttctttggcatggataaacgcttccaccaaagcctcctagtgatgcaaggaatcctggctttgttgcaatggtctcctaaaaaaaacaagcctttgtgtgggtaaggaactgattctcagscccattatctagtatctagtgattatgtatctgagatgtaaaacagaaacctaaaagccaaggatggagtctccccacagagcaaatgagcattttcccagtgactgtaggagcaaagaaggagcaaaactaagtttttatattcagttatcactactccttccatgaaaagctcccaatggctcagcataatgaggacttgtacactgcattttaaggagagtgtgtaaccccaaagtgatttcgttgacttgtcattaaaacaatcaaaaagtaagtaaaaataacaattgaaaatcctcayatcatcttcacatcttcttcccttaggcagagcttcgaccactasagctagagagctgagaggattaagtgcttgaactcagccctattggcggttctggtgatttgactccctccagctgagatcagactggggtgaccaaacattccattttgccgtggactttttaccagttctaatagttaaagtcctgaatcttgggaaacccctcagaccagaamagtcggttaccttcttggttcccttcttggcctaatcctttagcaatccctgtgtttytgagttcacatccaccatctctaagctctgttgttacctgtataatgccatttatcacaatgagttrtcactgcttgtttgctggtcactcagatgtctgcttttgcagggcacaaactacaactggagtgtctgttccctcaaagctttatacaatgcctgacacacagcaggtgctcaatacacttggtgagtgaatgtttgatcacagagtacttgactgaatgcttattttggcctgtgtctctccctctttctcagatataacagtttgtgyccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaaggcaagaaactctcctgacagtcttgcttctcaatgcagaatcctttcttcccatgcactaactccctctttctccyttgccctttcaagccacctgcaccgcagacaaactttcctcrgttcctaacaaccaaacttagatattttgctcttagatttataacttgctctttggggatggagaaagcgaaggaattggcaaaggttttttttttttttttttttttttttttaattaagcaaaagctaaagagatctctaacttcctcgaaagaagaaaagaggaagaaaacaaatgcatacatagagatattctttcttcgggttacttcatatgcaaaaaagacctagatgctagcacaagacaaactgcaaatttacagaagcactaagttgtagaaagtgtaaaagtttagcatgaaaacattaacctttacagtgggatgaacacaaagtctagcacagagaggaactcaatgaatgtgtgttgaatggatcatacatggcatatactgaggggtgagctccaaagaacactggggaattcaggtgggaaaataaatcaacccacgttatgtggtatcgtgtaaacaaaataactgattgttctactacacatttttgctttaaaactgttgagattagagttcatataaatggagactaaaatctaaggaaatgatatcacaataggaaatcattttgttaccaaaataatgtataagcaacacatataaggaagagatacttcatgagatcatttctgtttcttttcacacgagtagtcaaaattatatttgaagtaataaaaccatcatgatatccgtggaagatagagttcccaataatattaaaacaacaatgtaacttttgtttctttgttgaggataagtgcattatgtattgttattaatatttaatttttaacaacaattttattaggtactggtgctacttcattttatagattaagggacagatgacagaaaaatgagaatttaacaagacttaattcataaggtcttaagaagttaaaaattattagaaatttgcctgctcaagaagaaataaagggaatctttccaaattttttccctaacccctcctccttttcccccttttaaaattcttgccttttctggatgccacttaaagagttccaaactaaaatgttcaaaaattgcctgagcattactttcactcttattatattaatataaaccttccacaagttgatttaaaggatatgcatttcaatcaaccataatttcttctcttgagttatttcattgtctttctgtcctaactcagctgggatgcaggcttacattgacattaaaaactgcccaaagaaaaccrsgaatcttaagwaaataactcgtgagcagaggcggcacatgaagaggtgggaatacttcattgctgcagaggaagtcatttgggactatgcacctgtaataccagcgaatatggacaagtgagttgttggggttcataccactgggcaaaggttcaagacacattccatagggtcctagatgtttggggtgaaatgtaagttcacagctctcaaggggacacatgtattggtttctattcaagtctttttgtaaaaattaatcttgaattacccccaaatcaccaaagaaattcagcctaataataataaaaatgacaacagcagctaccttttgttgaatgtttgccattgccaagcactgtattgtccctttctgagagcttcgcttcaactctacaaactagatactgctcttatttctttttatagatgaggaaatgggtctgagagattaagagatttggaaattcaaatagctcttaaacccttgaaaagttactcaaattcactcataataacagaaatgcaaattaaacttcatgggaatactacttttatctatcacattcacaagtccagatgacatcatctgttgacaaggctgtgagaaaaaagaactatcatatattgttcgtggaagattaaattggtaaaaggattctgaagaataacttggcaatatgtatcaaaattctaaatgcatataccctttgactcagctatctcactctggaaatctaactatacagatacacttgttcacaggtgaaatgatgtatgtacaacatattcactgttgcaacgttagtagtagtaagactggaaacaacycaaaatgtccatcagtagaaaactagtttaataaattaggatacattcatacaatggaatactaagcatcaaaaaaagaggatgcaaacactctgtatgtactaatacaaaaagttctccaagataygttattaaattaaaaagctgggatgtagtatagcgtgtatayatagctgccttttgttaaaggagtgaaagggataagaatatttatattttcttatttgtaagacataaaggtattctggaattacacgcatgaaattaatatatggctacctagaaaattcagggagggtagggaggtcattttgagagtcatcagagaaaagtgagagttttcactgtaataaaaattatgtgaatgtattttctattaaaaacaattaaactaggaaaaagaacaaaaaaaatttggccaagattatagaattgttgacagaactgagataggaatccaggagtgtttggcaacagtcagtgctttccactgggaaaaataaattcataaaatgatattccatcttaaaagattgctgggttaaatgatatttctgactttaggtcttggaggaactgccatactgtcttccacaatggctgaattaatttacattccaccaagagtgtataagtgttcctttctctccatgaccttgccagcatctcttctttcttgacttttcaatcatcgccattctgactggcatgagagggcatctcattgcgtttttctttctttttttgagacggagtctcgctstgtcgcccargctggagtgcartggcgcaatctctgctcactgcaagctccgcctcccrggytcacgccattctcctgcctcagcctcccgagtagctgagactacaggggcccgccaacacaaatacaaaatacaaaaaatataattttttgtatttttagtagagatggggtttcaccgtgttagccaggatggtctcgatctcctgacctcgtgatttgcccgcctcggcctcccaaagtgctgagagtacaggcgtgagccaccgcgcccggcctcattgtggttttgatttgcatttctctcatgawcactgatgttgagctttttaaaatgtgctttttggccgcatgtagttgcttttgcaaactaaggtaataaagagggcaggggaaaagtggttcatgtttctgctcccaaagtatttatcccagtagctacaaaagatgggtgaaggaggttgcttttcagtcagctcagagaattggctagatggtggaagagatagcccaatagcacagaactatgattaacaatgctagtaaatgtttcctggggttggaagttgcttttagggattaagaaatacctttaaaaccaaaaaggctatcatagaataagtgataggacagactttagaaaaattcctagtatcttttcagccagtataggccttttcccagagatatcaaatgtctgctgtagcaataagaatgacaggaagatctaagtagctgcttctaaccagttacctatgacttttatcagtgatgcaggagacaaatcagaagtttccagttttccaactagacagaaaacataaggactttgcaaactacactaagaaatttttagagaactagtatgttagctaatctaagagcagaatgtttaagcacaagggtttccccatcctaccgagatctctatttgagaaagtggtttaatttttttttacttcactttaagaaaatacaggtctcagcatttggataatttctcaaaccaaattggaaaacattataagaaagttatgtacacacagtacgaagatgagtccttcaccaaacatacagtgaatcccaataygaargaagatgggattttgggtcctattatcagagcccaggtcagagacacactcaaagtaagtaacacaaatacagaatcatgggagaaattacatagtaaaatattatggagtacctggttattttttaattttaaaagaaaaagatgctcatataattttaaattcaaatgcaacttttagtttttatttagtatttgtatttatttacagcttrctcagtaatacaaaggatctgagacagtttctcaagttataaaggcataaaacaaggagtctatgtaattgggatagaataygsggacaaagaaaataaagccacagataagtagataccatgtgaccctgtaaggctgtcttcaaattttgtcctaagctttatggcagtcagtgtaaaaaaggaaatatgtcagggtgaagtttacatcatctacaaaaagaaagcaccatttatcctgatgttaagatctaagaggaacttctttaatgagttctacaaaagagagtgctgagtgatacagtagatggcatccttgataaaattcttataaccagcataatagattaaaagttgcataaaataatagattaaaagttgcattaaaatatttctcattatagctaagatataacagtaaacacaattgaatagaaacaatttttactcattttttaatgtagtctaggtatgcagctctctaatggttggactctgatgaaggtaaactccatgtatcaagagcacggagttttcctcagacaattctccttaaatgtcatgtcacttcaccaagatagataagaattggacagcagagaattaaaggttgcaatctttgacaaaatcctagagtgtagwtaatctacagacaaaggatgatccaaaggctttgacaatcaaccaaatagaagataggattaaggttctcttttgcagattaaagagcctaactaggactcctgtgtgttttatgcacctgacaaggtctattctgttcatttaaaatagccaaaggacaaaagcagttttttttctccatgcctctttcccttcttccatttctgatcccttttatgtgctctcagcaagtgtagacataccttattaaaagttcaggatctggctatttgtctgtgcctctcaagcaagtagcttttcccccycaccaagggtcttactctgtcacccaggctggagtgcagtggtgygatcatggctcactgcaacctccacttcctgggctcaggcgattctcgcayctcagcctctcaagtagctgggactacaggcacacgccccaaygcctggctaatttttgtatttttttgtagagatgaggtttcaccatgttgcccaggctggtcttgaactcctgagctcaagtgatccamstgcttcakcctcccaaagtgctggggttacaggtttgagccactgaacctagctgagaagatgacttcaaagacagtgtcctaaaaaatctaccgggcaggggaaggggatcatggtctagagatgagaagcagattcaaaatgagatgtggcccaagctgaaaagagaagggcaggggaaggaggacttgcttggagagagtgatactgtgaggaaaacgtcacttctcctaacctatcctctaaagtcagacttctctttccattttccaccttaatgtgtgagtgaaacactctctccaatgctcctgccaagtgatgaggggaggttactgctcagataaacagatctaattttccyactgtgtgtacacatgtatacacacacaccatccaaaaggtgaatatgcaaagctagtatcttatattatttgtcatgatcaaccttaaatcctagaataaatttgatttaactttgtagatcgtgttcaaaaatatggccagccgcccctatagcatttaccctcatggagtgaccttctcgccttatgaagatgaagtcaaytcttctttcacctcaggtttgaatctttcacttctactgaatccaactagtaacttctgagaggctgccacatttttctgctattctccttgcccggtggtgtcactactgcagtcaggtagtatacatgtaggagtatcctaaaaatcacagccaaacccttctcacttcaggagttttgtctcttagtggtaacaaaatatggtgtcttttattagtgtcatagtggcctctagtggagcattatctaatggctacatgttatccaggttccaagtagaatatttaaagaattcaattgaacaatgagaacatttagacacaggatggggaacatcacacacyggggcctgtcggggggggggggtggggggcggggggagggatagcattaggagatatacctaatgttaatgacaagttaatgggtgcagcacaccaacatgrcacatgtatacatatgtaacaaacctgcaygttgtgcacatgtaccctaraacttaaagtataatttaaaaaaaataaaaataaaagaattccttttgcaatattaattggttccagcgaaagcttatttatttatttattatcatgaaataactttgcaaatgaaaacaattttgaatatattttctttcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggyraggaatacaggtattttgtccttgaagtaacctttcagaaattctgagaatttcttctggctagaacatgttaggtctcctggctaaataatggggcatttccttcaagagaacagtaattgtcaagtagtcctttttagcaccagtgtgataacatttattcttttttttttttgtcttgtctatttttatcagtaccatcactgccgaaggcaagtctagagtgtgataacatattttgtcttagtttcaaattccaggtctgttggtatyggatgtgttgagcaagttgattagcctttcctaatttcttccttttatcaaatgggtaataaccctcctaaaaatgttacaggtctgtttgggggttcagtgagataccatctggtaaaagtataaagctctttaccagtctttgctatttttagagacctgcaatagggagacagaggagagattctctgaaagcaaccaaatttagagacatagttcctagtgaaattggacccagattatggcccatctctgttgagactaaagtatacagaagaatgtgaacaaagatactgaatttctgagtttgtcttcattgaagaattgtagtctcatattattaaactaaaattcccaattatgctaaactgtaaccaaagaggtcttatctcaaggcatacaaaataaacatatgcctagaaaaagcagaaatgaatttctggacatatggaagatcctgatttattgagctaggaaaggaaacaggtagtagaagcataaggcttttctattgcaaccttctctttcatcctttgcacttattcagagcatattcagtcaatcattcatgttgaaaggtgtgcaattacagagatagacagactttcagctgccatagcgaaatgagatttttcttttgggatttgttttttttttttttttcttttgagacagagtctcactctgtcwcccaggctggagagcagtggcaccattttagatcactgcaacctctgcctcctgggttcaagtgattctcctgcctcagtctcttgagtagctgggattacaggcgcccrccaccacccccatgtaatttttgtattttttagtagagacagggtttcaccatkttgkctaggctggtctygaactcctgacctaaggtgttccacctgcctcagcctcccaaagtgctggtattacaggtgtgagccactstgcccggctcttttgggatattttaatctctgaattttcttatctgttctgtttgcttttgcatattacctttagctctaacaagtgctgtgtacacaatggactctcataaatgcctgaattatatggcttcagtagttccaagaactatgtcactttggtttctgagaactcagtggtgtagataatttgctgcaatgttaatgactgaatacagcacttttttttcttttttttttactcttaagttcaggggtacttatgtgcaggatgtgcaggtttgttacataggtaaacatgtgtcatggaggtctgttgtacttactacttcatcacccaggtattaagcctagtatccaytagttattttttctgatcctctccctctttccaccctccatcctctgataggccccagtatgtattgttcccttctatgtgtccatgtgttctcataatttagctttcacttgtaagtgaaaacatgcagtatgtggttttctgttcttgcgttaacttgcttagaataatggcctccagctccatccatgtccctgcaaaggacataatcttgttctttttgatggtcacatagtattctatggtgtwtatgtaccatattttcttcatccagtctgtcattgatgggcatttgggttgatttcatgtctttgctattgtgaagagtgcgaaaatgaacatacgcatgcatgtgtctttataacagaatgatttatattcctttgggtacataccaagtaatggaattgctgggttcaaaggtatttctgactttaggtctttgaggactcaccatggtatcttccacaatggttgaactaatttacactcccaccaagagtgtataagtgttcctttttctccacaaccttgccaacatctgttagtttttgactttttaataatagccattcttattggtgcgagatggtatctcattgtggttttgatttgcatttctctaatgatcagtgatgttgagcgtttttttcatatgctctttggccacatgtgtgtcttcttttgaaaagtgtctgttcctgtccttggcctactttttaatggggctgtttgtttttttcttgtaaatttaagttccttataaatgctcsatattagacctttgccagatgcatagtttgcaaaaattttctcccattctgaatgttgtctgtttactctcttgatagtttcttttgctgtgcaggagctctttatttcaattaaatcccatttgacaatttttgcttttgttgctattgcttttggcatgttcgtcatgaaagctttgcccatccctatgtcccaaataatattgcctaggttgtcttccagggtttttgtagtttggggttttacgtttaagtgtgttgttgttgttttttgtttgtttgtttctgttatttttgagatggagtctcgttctgttgcccaggctggagtgcagtggyaygatctcagctcactgcaacctctgcctcccatgttcaggtgattctcctgcctcggcccctcggcctcccgagtagctgggattacaggcataagccacgatgcctggctaattttcttttcttttcttttcttttcttttttttttttttttagtagagacgggttttgccatgttgaccagactggtcttcaactcctgacctcaggtgatccacccgccttggcctcccaaagtgctggtattacaggcgtgagccaccgcgccaggcctacatttaagtctttaatccatcttgagttaatttttgtatatgatgtawgaaaggggtccagtttcaattttctgcctacggctagccagttttcccagaaccatttatggaatagagaatcctttccctattgcttgcttttgtcacagatcagatagttgtaggtgcgcagccttatttctgagttctctattctgttccattggtctatgcgtctgttcttgtaccagtactatactgttttktcctccagagggcagcagacatcgaacagcaggctgtgtttgctgtgtttgatgagaacaaaagctggtmccttgaggacaacatcaacaagttttgtgaaaatcctgatgargtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtgggtgacatcatagcaacatttttaagcaagaggtcaaaggctcacatccttagaaatgcgtttgatcttctattccaagcgtgtgtgtgtgtgtgtgtgtgtgtgtgkacacagacatactctgcgtggtgaggaaaagggtgagrgagtaggactaatggaaggtgttatagtccatgtcaatagtatcctagactgagttcagggtgaatatatggcyaggacagaaasaaggcaagtaatccaaagatggattgacacatcaaagtagagcaaaatgagtatagggacccaagagtcttggaaaggcatgcatgaagacrtttcaagtgatcagtaagatkttcagaacaaaaggaattccctgaatgagggttccggcatttgctgcagttctaaagttcagtggccaaaagcactgccatggcagtctgagagaaatgtcactgagccagctggaagcaaacttctccacaacagccagggtccccctactgatcctcagagtctagagtcatggtaatcaccttctctagtaggtaatcacacatgtgaggatgatttctgcatgttctgttcatatagcttcagatgacygacagctagggattatcagagctgacaggtgccaggtcaaataattcaaacagaaaattactctcagctttctttgcataacttccttttggcagtgaatctatcatagttctagaccagtgctgtccaatagaaactacgtatgagctayatgcgtaatttaaaattttctgatagcaacattaaaaagtaaagagaaataggtgacattaattttagtaatatgttttacttaactcagtatatcctgaatattatcatttcaacatgtaaccaatataaaaattaatgagacttactttattactaagtctttgaaattcaatgtatattttatactcacagcatatctcagtccagtctacccatatttcaagtgctcgataaccacttgtagccagtggctaccatattgaacaatgcagttatagaccatttagaaaaacatctagaatgaggtataaactaataatacatcatgtaaattattaaagtcacttaagtgatttaagtaggtatttaaatatttgttaatgccagtcattatactggtactaaggctaagagtggtaatsgaggtagacatgagcccygcccttgtagaaatcatacctttggttttttactatgcttagtacataagtaaataaaaatattgcctacagcagtgtcccttttaacaataatgaaatgtatgaactggatactcaaatggaaactgtgaatactatgtagattataagacagcaataaaaactataaaatatgctaaatgggctttatttttagggacattacttcttacccaatgactaatatatcaaaaagatgaatttcttatattatgcttttcctccaagtggaattattagaatatctttaaaggcagagaatggagcacaaaatatttactatacatttgaygaatgactaaatcaatgtaaatggaaggctttatctttttcctgagatttctcctttggctaatttaggagaataatctctcatttgaaaattctgagtttgatcttctagtcacatgttagactagataaagcttatcttggataatcactgctttgacacaaccaaattaacatggagacatttatcttaggtataattagacacatgcccttttgttggcatagacttggaattttaacagattttacactttcagctatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgacmctcttccccatgcgtggagaatctgtgacggtcacaatggataatgttggtgagtaagagtctggacactcacagaggaagcttgctttgaatttctggtctataaaggtctgctgcaactctccaggctaccagtgctcctctatgtatctccctgaccccctgcaggcttttctttcaatgtttctcatgatttctctttgagaaattaatgacttaaatggatccagttctttagtgtgggttatatttttccttctctgggcaaagtaggaagtaaaaatatacaacagcagaaaaataaggcataactctgaggaagaagcataaatattttggccacaaaagagcatttcttttatcaaaatgccctattcggttttttgcaacagtcatcttcaatcatcaggtacagtgccttaaaggctgcttcagcaacagctttggagtttgtcagactggaatgcaagtcctgatctgccaatcgattgctgtgtaaccttacacaagttacttggccacactgagccacaagtcatttatctggaaaacagtgtaatcacatctcacagagttactttgaccattaaaatagtaatatgygccaagtgcctagcactcagtagacaccaacaatggtaactattggagactcaccaagaaatctttratgttccagcaatgcatgccatttcagagattcaaaattgtcctcgtgaattattacttagaaacatctaaatgtctcttatttgtggggatagagctcatcaccatccctttaattctaagacaagatgtgctgttaggatatttatgatattaaaagtccattttattcttgattcatccctttcttaatatattttaaaatagtgagcaactatctgtgctgaaagaccttttttcccctctaatctccactaagcaacacttttgttttttattctgttaagcgagatgaacgcactggtcatgtgcttagagtcacagcaatgtcaaattgctttagaaaaacaaaagtttactaaatatttcattctcatttttctctccttrtgttattttgacccagtaatcaatagktcacagacaagcagtggtccacagcccatacttgaatattcctgacgaaagtttattagaaattacctgccacaatggattattgtgttttcatgtcttttcccagacttccagatctctcttctgtctgtctctcttctgtaggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatyaggtcattcygaaactcatcattgaaycaggaagaagaagagttcaatcttactgccctagctctggagaatggcactgarttcgtttcttcraacacagatataattgttggttcaaattattcttccccaagtaatattagtaagttcactgtcaataaccttgcagaacctcagaaagccccttctcacyaacaagccaccacagctggttccycactgagacacctcattggcaagamctcagttctcaattcttccacagcagagcattccagcccatattctgaagaccctatagaggatcctctacagccagatgtcacagggatacgtctactttcacttggtgctggagaattcaraagtcaagaacatgctaagcrtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggraggaccctcctagtgatctgttactcttaaaacaaagtaactcatctaagattttggttgggagatggcatttggcttctgagaaaggtagctatgaaataatccaagatactgatgaagacacagctgttarcaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacrttgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcasagatcctcttctccagagctcagtgaaatgcttgagtatgacygaagtcacaagtccttccccacagatataagtcaaatgtccccttcctcagaacatgaagtctggcagacagtcatctctccagacctcagccaggtgacyctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttcyccagccctcggtcagatgcccctttctccagacctcagccatacaaccmtttctctagacttcagccagacaaacctctctccagaactcagccatatgactctctctccagaactcagtcagacaaacctttccccagccctcggtcagatgcccatttctccagacctcagccrtacaaccctttctctagacttcagccagacaaacctctctccagaactcagtcaaacaaacctttccccagccctcggtcagatgcccctttctccagaccccagccatacaacyctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagmggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaaggtttggccagttttctccttttttattctcatttttccattactgctgmaaaaagtagctactacaattcagggggataattgtgggcaaattatactaagaacagtgtggttcccctattgcaagttggcctgttctttttcctttgtcaattccaagattgcttctttaccttagatgacccctggacaatataagaacaatcactgtgagaactctataatattctgtaattaagcatttttctgtgtcctctcctcttactacccatgtttctactgactcttattgctccaggcagagcccaacctatccatagctatatgctaatcaatatgatttaattgaagttagcctcaaatccaaactcaaatatgatgtagaaatctcctttttgcatttacttgtttagatcagaatttctaagagatccaaatcccttttttaaaagaatatttacaattcagttttgcttasgggtagaaagccatgttgaactgggctctttgttctgggatgaagatacagaaagagaagagagaggaggaaaggagcaaggcttagtcaactacaaattctcagggatatagcatgatgactgtgcatcagctgtctagatatgcccacagcttttactaaagctgttacactaatcacttaaaaaaccaaagtgtaattacagtaggcaaacacaatgtatggtgtgacttatgcatatgagttcattaatctgatgcctgacatctccacattagaactctgtttaaaacaccttttcctatgacttcctatwtaaatgttgcactcaataccacatgagaacaactagctacctgagtatttctaagcaaggccccgagggagtgagatgcagggcctgtccagagtgaatagggatggaaccaccttcaaaatcttgtattccattcaaggctcacaacccacttttatggcaktcggagttgctttacccactcccttgtgttctgtgagtttgcatgttatgctcagagtctggaaagatgggattagtaggggaggtagaccagaagaaaggcagaaggagattctctgttgatgactcacagtatatagcaaatattatgggtttgatgggtgagtgtttggcttgtttccacaggcttgggaaatgtgagagtcagtgggagaattcgacatgcttcagtcctagactgagccaatgaactagatggaaataatgtgctttatttatttatttataatttgtaattaaactttttattttggaacaaaaataaaatagattcacatacagtcaagagaaataatacggagagatcctttgggtatcctgagtattctttacccagtttctcccaggggtaacattttgcaaatctataatactatatcacaaccagcacactgatgttgatactgtcaagacacagaatgttcaccatcaccataaaaatccctctcattacccctttatagtcacatctgccttcctcccaccatagcccttccttattccctggcaaccagtagtctgatctccatttctrtaattttgtcatttcaagaatattacataaatggaatcaggcaacatgtaacctttggggactggtattttttcactcagtataattctctggagattcatctggttattgcatgtattccattatatgggtgtaccmcagtttttttgttgttgttgttttatacacatttatggtgtaaacatgatgttttaatatatttataaattgtgaattggctaaatcaagctaattaacctatgcattacctcacatacttttttgtggttagaacacttaaaatgtactcagcaatgttaaaaattcagtgtgttgttattaactacagtcaccatcttatacaacagatcttctaaatttatttcttctaactgaattttatcttttgaccattttctcaatgctccacctctgtatccctttgttaaccactgttctaccttctgcttctatgagctcaatgtttttagtttccacattataagtgagatcctgcagtacttgtctttctgtgcctggcttattttatgtaacataacgacctcctggttcagtcatgttgtcacaaatggcatttcttcgttttcttttttttaaatgctaaatagtatttcattgtttatgtagatcacatttaagaaatccattcatttgtttatagacatttgggttgcttccctatcttggctaatgtggctaatgctgcagtgaacgtgggacagcagatatctcttcaacatactgatttcattttctttgggtatatacccaaaagtgggattgatggatcatgtggtaattctatttttaatttttaaaggaacctcccatactgttttccataatggctgtactaatttacactctcaccaagagtatacaagagttcccttttcttcacatccwtgccaacatttatctcttgtcatttttataatagccatcctaacggtgtgaggtgagccctcattgtgattttaaattgcatttctctgattattagtaatgttgagcatcttttcatatatttgttggtcatttgtatgtcttcttttacgaaatgtctattcaagtcttttgctcattttttaatcaggctatttgggttttttgctgaattgagttccttatatttttaatattaatattcttatcagatatctggttttcaagaatattctcccattccaaaggttgtctcttcactctgttatttcctttgctgtgcataaacttttgagtttgatggcaatcccatttgtctatttctgcttttgttgcctgtactttcgaggtcaaatccaaaaaatctttgtccacaccaatgtcaagaagcttaagaataatggacattagcaaaaaacaaatgtgagaagagtggctacttttagggtacaaaacattcacccatccagtgactttcataagtgtgaccttctaattaatctgaccattgtcacctgatagccccaagctctggcactgtcccattacatggctttgtctgcctttgatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatctacaatatataytctagagatattataagaatactacaggaatttactatatatactataataatactatagaaatatgagaaattgatatagagacttgacctagtctaaaaggtcataggaagacttacctataaaataatatttgagttaggaattgaaagatatttactggcttttgtttttatccacttatatatttactcatttatccaccaagtatttattaaagaccttctctatgctagatgctatatttagaaagagacaatttcctaaattctgggaacagtctttaatttcttcttttacacaaatagtattattatttcagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagtaagtcttttgagcactgctaagatcttcggaggaatttccacaagcaccagagggttgtaaaggtgcaggtggcaagagagctataggtgatttgtttgttttccaggattaatgaataattacatttcttttcaaagactccttgccaagcaatttggcaatcttcgaactaaaaaaaaaaaagatctcattttttaaatgctgaaaactatataatctgtggaaaatctttctgtaatttctatctaaagctaacctatctaaagttaacacagaaaattaatatattcaagagcaattgaattgggtttcatagcagtggtggtggtggtggcagtagcagtgctagtagtaatagtaatttagaaatatcttcaggtgttttcctaaaaattaaataaaatgaagttaaataaaatgagtaaggaaagtaaagatgtctccatgccctccaaaagtgagcaagtttcttcagtgtcttcctagttctggtaatttctttcaaaatcttgtgtccagacccacgattataacttgcttttataacaaagtttacttccgccatttttgctaaccgctcacrttcaaaaacccagaaagaaccctgattctaaagtaagctattctagattttaaaatataatctactatacctgtgtaagcattcactacattttcagtgaccatttgctctttttaaaaacgtaaacaagtacatagggatataagaatcttaattattctaaattttccatgaagctatgggaggcaatattctcttttatgattaggggatcctttttcaagatgaacgataatttaacacaatatttaaaaaacttattctaagtaactcaggaatcaaaaaccagacactgtatgttctcacttacaaatgggagataaactgcrggtatgcgaaggcagacagattggtataatggacattggagactcaaaagggaacgggggatggatgaaaagctacctattgggtacagggtacactactcaggtgacaggtacactaaaatcctagacttcaccactmtacaattcatccatgtaaccaaaaaccacttgcattcctaaagcaactgaagttttttaaaaaatttaaaaatcaaaattaatgcacgaaagccacaataaacaaaacctcacaattgtgaataaagacaggataagtaacaatgttgcattgagacatactggagccttaggcaaaaggaaaaaaatcaaatactgaatctttgttttagccctggatttcactagataaaaatgacttcatttgtgtatttttaaaataattttaacttttattttagattcagggggcatatgtgcagttttgttatctgggtatattatgtgatgctgttgtttagggtatgattgatcccatcatccaagtagcgtgcatagtacccaatagtttttcatcccttgctcatctccttccttcccccttctagaagtccccagtgtttattgccatctttatgttcatgagtacccaatrtttagctcccacttataagtgagaacatgtggtatttggctttctgtttctgcattaattcacttagcataatagcctccagctggcatccatgttgttgcaaaggacgtgatttcagtctttgttatggctgcgtagtattccatggtgcatatgtaccatattttctttatgtagtccaccactgatgggcacctagattgattccatgtctttgctactgtgaataatgctgtgatgaacatcctagtacatgtgtcttttcagtagaacaatgtattttctgtctttctttcttttttttttttttgagayggagtctcactctgtcgcccaggctggagtacagaggtatgatctcaactcactgcaacctctgcctcccaggttcaagcaattctcctgcctcagcctccygagtarstgggattacagscacccrccrccahgcccrgcyaatttttgtatttytartagagacrrggtttyaccatgttggccrggstggtctcaaactcctgacctcgggcaatctgcctgcctcagcttcccaaagtgctgggattacaggcrtgagccattgcgcccggctgaacaatktattttcttttttggctatatacccagtaatagaattgctaggtcaaattgtagcaggacaagccacagacaaaaacccctcagacaccaagttaaagaaggaagggctttattcagccgggagcttyggcaagactcatgtctccaacaaccgagctccccgagtgagcaattcctgtcccttttaagggctcacaactctaagagggtccacgtgagtgggtcgtgattgattgagcaaggagggggtacgtgactgggggctgcatgcaccagtaattagaacagaacagaacaggacagggattttcacagtgcttttctatacaatgtctgtaatctatagataacataaccgattaggtcacgggtmgatctttaactaccaggtccrkggtgtggcgccgggctgtctgcttgtggatttcatttctgccttttagtttttactwcttctttctttggaggcagaaattgggcataagacaatatgaggggtggtctcctcccttaaaatagtagttctgtttcaaattctttgagaaacccccaaacttctttccacagtggctaatttacattctaagcagcagtgtataagcattcccttttcttcacagcctcaccagcatctattttttgactttgtactaatagccattctgactggtgtgagatggtatttcactgtggtattgatttgcatttctctgatgattagtgatgttgagcatttttttcacatttgttggctatttgtatgtcttcttttgataagtatctgttcatgtcttttgcccactttttaatggggttatttgtatttcgcttgttcaattgtttaactatcttatagtttctggatattagacctttgtcagatacatactttgtgaatattttttctattctgtgtctgttcactctgtagatagcttcttttgctgagcagaagctctttagtttaatttgtcaatttttgcttttgttgaaatgcttttgaggaattagtcataaattctttcccaaggctgatatccagaatggtgtttcctaggtttttcttctaggattcttatagtttgaggtctgacatttaaatctttaatccattttgagttaatttttgtatatgatgaatccagtttcattggattcattggggttcagtttcattcttccacatatgggtagccggctattccagcaccayttattaaatatgagtccttttccccttgttttttgttgttgttgttgctgttgttgttgactttgtcaaagttcaggtggttgtaagtgtgtggctttatttctgggttctttattctgtttcattggcctatgtgtctgtttttgtatcagtaccatgctattttggttattgtaactttatagtatagtttcaagtcaggtactgtgatacctccagatttgttctttttgcttaggattgctttggctattcaggctcttttttgattccatatgaattttagaatagctttgtctaatcctgaggaaaatgattccagtagttgttaaaaaatagtgttgaatctgtagattgctttgggcacaatrgctattttaacaatactgattcttccaatacataagcatagaatgtttttccatttgtttgtgtcatctatgatttctttcatcagtgttttgtaattcttcttatagagatctttcacctctttggttagatgttttcctaggtattttgtatgtgtgtgtggctatgtttaatgggatttcgttcttgatttcgctctcagtttgaacattactgatgtatagaaatgctattttgtacatttgtacattttattttgtataattgattttgtacattaatcttgcatcctgaaactttactgaagtcatttatcagttcctggagccttttcatggagtctttagggttttctaggtacagaatcatattgccaatgaagagagatactttaacttcttttcttctttggttgccttttatttctttctcttgcttgattgctgtgactagaatttccagtactatgttgaataagagtgatgagattgggcatccatgtcttgttccagttctcacggggaaggctttcagcttttgctcattcagtatgatgttggctgtaggtttgtcatagatggctcctattagtttgaagtatgttccttcaatgcctagtttgttgagggtttttatcatgaagggatgttaggttttatcaaaagctttttccacatttattgagatgatgatactgtttttgtttttaatgcggtttatgtggtgaatcacatttattgatttgcatatgtggagccactttgcatcctaggaatgaagcctatgtgattgtgatgaattaatttttaatttgctgctggatttggtttgccaatattttgttgaagatttttgtgtctatgtacatcagagatattggccggtagttttcattattcattgtgtctttgccaggttttgttattagggtgatgctggctttgtagaataaaataaggaacagacaattagggagtctttaatcactagaagttatagaagggctgggaggagcttcatgggtctgactgctggggtgtgaagacttctcatatggcatttaagtcctttaccatctggccccaacctgctccttttctascctcatttctcaccaggttccacctgtccctgtgcatttcacagcccagttccaccgagatccttgctattccccaaactcttcctttactcccctgctcacaggcatccttctgcccttctgagagtctgaaatgtctttctagctcctgttcattctatgatggccaattccatttcctctaagaaacttaccttaattcttccaaccactcctaaatattcaaccaaattgttcctccagggcattgtcatctgaacccacttagactttgtatatagcacctgttgtctccagatttgtagtgtggatgcccatgtgcatgtctgtttcagcagkagcttaaaagcttcttatgaacaagaatcaagcttctttcatcttcacatctccactacctatcactctcatttcattagtagataatgtcagtactttagccttgagcctaagaacaaatatcttttggtatttctggagaaaactacttgggccatatctcacaggatggttatgaaaattaaatgaaataatatacataagttattttgtaccttatatcttagctccgattttataaccagccattttgacttataatgctgacatttttgtggtttagatttttgttaagcttaagtacatttgtggatcattccttttcctaggttcgttttaaaaatttagcatccagaccgtattctctacatgcccatggrctttcctatgaaaaatcatcagagggaaagasttatgaagatgactctcctgaatggtttaaggaagataatgctgttcagccaaatagcagttatacctacgtatggcatgccactgagcgatcagggccagaaagtcctggctctgcctgtcgggcttgggcctrctactcagctgtgaacccagtaggtactttcattgaaagtttttctcattcccctaacctcgtaatctgaagtccaccaaatggaagagtcrgggttatttcttgtcaaatgtctgtcttgcttttcatgaggaatgcataagggtgtggttaacagtctgcatttatcataaccagggactctccatgcagctcttcagatgacagagagagaaacatttattcagtggagaggaggaaagattacttgaatgattggccatgaattagaatgcctacatttacagaagatggcatttatttgaaattttcttgaacaagtattagctatgttctgctctttctttrtgaaaagaactgcaaagtcaagactcctttatctgwcattctgcaatgtatatatacttcaaaacaatatgtcatacacagtatatgcatacaattttatctgtcaattaaaaagagaaacaactcctccatttcaggcatagtggaaagagcacagactcagatttaaatttttaccctgtcaatgcataatcctaggaaattccttgacctctcttagcctggtatcagaagttaaaaatgagataacagtacatagtgcatggtaagcacttggtaaatatttgttcaatgaatgaatttatatttaccakataagatagttgtcaggattaaatgggagattgcaggcaaatcatttaatatagtaatagattctcaataaatagtatcccttatattatcaatttattattatcatcattgttactgggataaagatcaatcagaggaaggaggattatgaatacaacagaattaggtgataaatatccaggcttattaygccattcatttataatcttcatcttcaaattcagagcctatcagaaagtttccttttctatatgatgagtgattatcagaagagcaaggaaattcctgagaaagaggcaatacaatttactctgtttttccaggaaaaagatattcactcaggcttgataggtcccctcstaatctgccaaaaaggaatactacataaggacagcaacatgcctrtggacatgagagaatttgtcttactatttatgacctttgatgaaaagaagagctggtactatgaaaagaagtcccgaagttcttggagactcacatcctcagaaatgaaaaaatcccatgagtttcacggtattttcctyrgactttgatctaatctcctaattaaatcacactgggtcacagtgatttctgcccttagatattcacaagattagacatgagatgcttctgagacacccagagctacaactaaaaccggttccttaacattccagagggctgatgtaatctggcaggtgacactgtgggtgaggcaaaaagagaaagtctgaaagatagcacagagaagctgctgcaaaacaaaccaacagaaaaccacaacaacaaaaagccagtgtgcttcagctggtaacatacattgaaaaggaattaacattgttctgcaatttaaagttaataagcttgtttctggatctctaaaggcacaagtgtttatataaaagaaatgatcacctgtgtgtcttttctaaaataagaatgacgctaacagttttagctctcagcagctaccaggtggcacccaaagcatatgagaacaaaatgagataagaaactaggtacccaggtaataggagaatagtggcaagagagcatttgggtggtcacactgggaaaagtgtgcctatttggaaattcacaaggaaaatttgccctgtaagctagtaactgaaacagraactgagaagagaaaggtacgagcttgtgttatgaatatgtagataggtgttctcacrcctgatataatttgaaggatgcccaaatgatctcaacccgtccctctccaaaaattcacctgcctggtttctgaaatttcacagcagttcctctaacttaagaaggaggaaacaaagcacttccytcactttggtttcagttaaacgtttggtaacactaaactttatctttacagttttgtgttacatttttaaggtgatcaagtttctcaggaactttttaaaaaatccgcgtattttactgtggggagagtagataaagcctgagaaccctagttatctaatctgagaagtgggcagaggagttgtcataccaataagagaataaacatgacttgctatggttgctggatacaccaaygataaactcctaattttataaactcctagacttcctaatttgcctgaaactttctctgaatttagaaggccttaaggtgacatgctgcatatctccttgctgactctaatccctggagtttactttgtctgcccatatttgtatttatcttttgtagttaaggaaaattaagactgttaatggaaagtatacacgggtaaagcacggaactgtaaaagctgaggaaaagagtgataaactgcttggaaagggagttccccctgccttctgctgtaggctggtgtgaatgatatgagaaggactagtggttctgctttagcctctcactaatgtgacatacaagagggccctttccatggctaggtaggcctgggaatgcagaatcatgaggaacatgggtgttgagtgggttgccccatatttccttaccactcgccctctctgtgtcaacagatttttaattgatttcaactctttgtcctttcagccattaatgggatgatctacagcttgcctggcctgaaaatrtatgagcaagagtgggtgaggttacacctgctgaacataggcggctcccaagacattcacgtggttcactttcacggccagaccttgctggaaaatggcaataaacagcaccagttaggggtctggccccttctgcctggtaaagattgggtaatgggaagaggtccctgctaagaaatacagggaaaaggcaatctgtaactccttctcatttcttccttgtgcatatacttcctaaggggtcagaacacagggttctggcatagagcctaggcaaacccatagacccaaagtatatacggagtacaaaaatgtcacctaatttatgaactatttgcagcaccacacaggctaaatgtgtgacccaactcagttgcaacataacatgcagtttctcccaagccactgtrtgtcatacagatgaggtcttaagcagatgaaaaaatgaatcccacagggctcaggcagctacagctatctctgctgggagggtttccagattcttcagttctgctcctcttctaggccctatcaccctaatatctttgggcaagtgactccaggaatcacattcttaaactgacttatagactgtttgaagaggaaaacatttttaaaaaataataataaaagttaaagaataacaaaggtatttagaacttttcatgtgcaaaataaagataaatgtagatttaaacagtctacaattatacagaagggatgtttctgtgccaatgagttgtttgtaagtgtatctacttgtgcagcagtataaaaacctaggaagtcagttaaaatgcagatgtgaaggcagagggattttgttctcagagactttaaagtagattttgggcagaattccaaggagtctgtatttttaacaagcagccttccttctattttgccttctattaaaagtaatggcaaaaaccgcaattatagtttgcaccaacctaacacatgctgcctgaggagttagtgaaggcagcccctcgacagcactttgggtgacgttgtgtgaatctgcctcagatgcagrcacagaagtccaaatggactggtttgattaagagcagggaaaaaaagagggttcttattggtttttcacatgccagtaactcactaatacatctagagagtattaattgtattatattaatatcatattaattaattaatataataattaatagataatttattgtattaaaatcagagacagaagagattcagtcaaatttactcatcttttcatcaagtattagaagatcagtcatccttcctatcagcctgcagacagactgagaagctaggattggctggtgtctctaaatctgcaaacctaaatacctgcattggagagaggaaaactggagacatttttcagtgtgtttgaggaagataatcatatctattcattttcacccacaatctgggaaacagtcataaattatagtcaacagaatttaaatattaactgccagggggtaatgttaaataccagaatggatagccagaggttttagaaatctcattctttcagtgttttttctgagcaatttatgtaaatctctattcaaatatgtaagctttatggaaaacttgaaaacatggaggaagaaggttttatttttattttcttatataaaaaagagaaaaaagcaaaaatgaaaagagggaaaggaaacatgtatgatatttttgaagcccaatgatgtcattcgaggtcactttgataattaggactgtgaagctgtattgtatgtgagttaatttgtaacattatatttagataagtgaaagtttcttctagtgaggtgtggtggtgatttaaaattttttttagttatctctgtgtatgtgttgttattgttttgtttttatctgttatactttcagtcctacctaaagaaaaatggttaaattctatttgaaagcctcttgtgaagcaggaattttaggattcttagagaactatcaaccacaatatttacttgttaatttttgcaaatgtaatgttgttctttttattttaggttcatttaaaactcttgaaatgaaggcatcaaaacctggctggtggctcctaaacacagaggttggagaaaaccagagagcagggatgcaaacgccatttcttatcatggacagaggtatcacaagagccatgtgatatttggtttggcaggagagtgcctattactagaatattaccaacttttagattggaaatattcaactctaagaactctgatgtgacaaaggcataatttgtagccataattgctttyattccggcccatggtctgattgcattgaaaacacatcagtcagatcaaaagcattcctgtcaattgggaaacctgtgtaaagcatccttcttcatgacttgtgatccatggacaagtgcatataagaaattttccagcttccaagagttgaggagggaaaaggtcacaggaatttaacaatgactgagtcacyaaacttgacatttcagcatttaggaaacacagttttcatctgtccatctgttcatccattctttaagccattactaagcactgttgagtatgaagcactgtgccaacatccaggtagcacagtggctggtatcccttccttgatcaagatataaataaccttgtaactttgaggtcaacttttgagaacatagtctcatcaggactagaactttttttcatatttttatattttgtatttttattttttttgtagagaagaggttgcccaagatcaaactcctggcctcaagtaatcctcccccctyrgcctcccagagtgctaggattacaggcatgagccactgcacctggccatggatggtacctaatgttgtaaaatagcataatttaagataaaagcagragaaaatcagtttaaaaartgattacatttcaggatttcagttgctttcttctaggatgccactatatctattaaagcaccagtcttgttagtgcatttaccattttataatcagatatatttaagtcagggccacacaaggtaggtaaaaatatctaattattgagtcagaaacataatccctaaccatggagttttactttattrtatatattttrtaagcaaaaattattcattttttttctgtttttcatagactgtaggatgccaatgggactaagcactggtatcatatctgattcacagatcaaggcttcagagtttctgggtaagttgtagcaccatggtctgtgaatggtaccccctacagttgtgcagcatgcagcctatgaaaccatacatgacaatcctatctatgaatcagtttttctctttatgcttttctctackacaatgtagtgaagcagctccatttggggtacatatatggtaaaggaaggaacactayggtaggagctaaaggcctgttagtgtgctcttaacactgccacctcttctggtgtataatgatcccaaagagtcttttccaggaaaaaccgatagctgggggtcattgatttctctacataaaaagcccagcctctctgcagggatttggcaaggatcagataccttastcttatgaccacgcgcccatttccaaaactctcctcagtcatcttttctgggtttgaccacacatgtagtatttcagccagattcacagggtcttatcagccaggcattatagtccccattaatatggccctttgcctgtggcaaccattcatctattcagaaaactttgttgaacctccactatatgtgaggaactcctccaaagttttcccacactgcctcaaagcccttcccaagatcaagaggtcatgatcaagaggatgatgaggctcccatatacccttccatgtcttcctgttaggcaggcacattcagcattaggaatataaacacaacagaaaaaatcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataataaaaatgaaagtgatttagtaattccttgttattgttcttgcaatgttgttaggggaaatagcaagtactaagtgtgaggcactgttctaagtactttatatccttaaaatcaaccctctgaggttggttctaataatatcttgttttatagattaaaaaacaaaaggcacagagatactacctaccttcccaaagtaacacacagctaattagtcattgagttgggattcaaatttaggtactctgtgcccaaatatgaattgcatgtagtcattgtatcagtttgctaagatcttatgtgctagctctttagttctraagaaagctgattgtataatgaatttaggcagtgtgtgacttgttgacaaggacagttctgtttactggctttcctatattgcaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatggtttgtgtgcatatttctatctgaatctctagactctagacttggcctagaattattatgactatacctaatgattatgtattttaaaaaatacctttctgggtattagaaatgtgaatggctttctaagggtcatatggagaaaagcagtaatatgataggtctgtgtcttacaaattaaagagagaagcagggttactgaaacttcaaaaccccacaaaactttaaaaaatcattttatcatcaaacaaaatacccagatttctcagactggccaatggtatacggcagagtagaacatctggtcttgcrcctcaaggagctcatgctaaaaattggctaccaagacttttgattttactattgtagtttgttttgttctttatttcagtgtacctgaagtaaatagtagtgttaatgctagtaagcctctgaggcagtgtgattctcagactttttggggggccatgcctgaggaatgacattctccttctggttcttccaggggctcagccataagccctaactcttctcctcctctctattcccttccccaaagaagtctgaatgcaaggagtctgcctgccattattataccaataaccttgagtctgtttctgcttatattttatataaaattatttactgtttattagttacctatttttaataattatttatactatgtctcagaaccattgaaatcctaaattatggttcttactaatcagtattatgagagaaaacacagattgcagttgagtccatagcataaagattttgtcgtctatgttcatgagaggatattggtatatagttttatttttttaattgtctttttctgtttttgataccacagttatactagctttcataaaaytggtaagcatgctcttttctacattctaggagaaaatgtctgcaattggtaataattctttaaatatttggtaggaatcactagtgaaaccatctgggcctgcagatttctttttgggcagtttttaaattacagatcctatgttctaaatagttacagggctattaaaattatctatgtcatattgggtgaattgaaatactttgtatatttcaattaactggtcaattccctctacgttgttaagtttatatgtgtagagttgtttgtatattcccttatcctttttcatgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcrgatcacgaggtcaagagatcaagaccatcctgaccaacatggtgaaaccccctctctactaaaaatattaaaaaaaattaggcagggtggcgtgcacttgtaatcccagctacttgggaggctgaggcaggagtatcgcttgaatccggaaggcagaggttgcagtgagccgagatcacgccactgcactccagcctggtgacggagtgagactccgtctcaaaaacaaaaaaaaaaaaaaaatcttttcacagaaccagccttgttttattgatttttctctattgtttttctgttttcagtattaccgatacctgctccaatcttctgttttaaaaagttggctttttctgacattgctctgtcaggaaaaggggtagggcacagcctgtttactgccaagtgggggtcaaagtccaggttccccactccattgccacctaagaagggattgttccttggtggctgggtgggaagggaagttccccatttggcmtccactgatactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttggctaaaggasagaagtcagtgtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcacttyatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggtaaggtacaaagatgcattattttctcactgccactcaaagaatcaagatttgggaggtataggagaatgagtagaatttttagttcttttcagtgacttaggctcctaggaaaacctttgtgaaacagaggttctactcaggtaaactctcagtgtgatctagaccaagartggttctgccaatcagagtgccgacagcatctctgtgaagaaagtgcctggattatatagacacatcacaacyctccaaggaagggctctaatttggaattacctccatcagcccattttcaataagacctacctgagattcaaactaggcctgactcttccaaagtcctcaggtcactcaaacttcaatgtcatgacagtatctggcaacatcactgccatatatrtggtgttcaatgagtgtttttgaaatctgaattggcttcccaacttcctgaaaccacaattcttctttatattttctttcataccctgtgtaggtactcaagtcttttctatgttagctgctatttctcaggggctgtaatgtgacctgtggtataaataaatccaggtaatcataaatggtcataataaaattctactatatatagcaaggatgtttaagagtcttaactgttcttcttggactcttaaagcagtgctttccaatattttttacttcaaagcacacaaagaaaataatatctgcctggcattctgaggtaaaagaatgaagcawtaaatctaaggcttggctgatccaggccccacttggctgctgaagggctggaggtgggaagagggatcaataaataggtgcactagaaacctgccrtgrcacacctgtcaggagttgcagtacttccctttgggtggagagaagccaccatgattcacaatggagaaagtagctgaaacctggaatcagtttcctgttgaagcagataatggcacagtatacccttggatggatatgggtattttgccaatgtccagatagcagtagtctaaaacatctcccaaataaaacacagatcttgtatcggcaggaccactccttgaaacagttccataagtcattgcgtttttttctttccatatggtataaatagatttgttcagatcctaataaactaccctaaaatgtgacattcaattctgctaacttatttaaaacatctattttttatacaagaagcattattttcttcttattcattttcttgatacttaggtaattattagcagtgggtattatttttaggaccctttgtttttttcatggagaaagtaaggcatcacttcaagaaaatttctgcatgatttaccaacaagaacaaagtgtcacagagatgatgggtggtcagccaggttcactcactagctgtgtttcttacagtcacaggtctgccttgctgcctatgatattcaaattacaccttggaaaaattccaaagggtacataactcgaattaccctctaagggttgaaacagaaaatattaaatagtgactgagggtccattgtatcttcttggtagcttttgttagaagaaacagagtatttttatatatagataatttaggattattgtcacctgaaagcaaagaccaaagtttccaagactctcagaaggaggaagtgagtttaaatgtttagaacatggtatttggtatcagattgtctgaactcaattcagtttctgattcttgtggctgtgttaccttagacaagttactgtgttttggctgtactaaaatggagatatttatgagcattatataatacatgtaaagcctgagaacagtatttggcacttggattcaataaatcttcattgttgtggttattgtttttgtcatttgttggtagtaatattatttcttatctcctctgcagtgcatgaagccatgcagggaatattggtgtgtaattaatcamgttacttttcttttgataggatgttccacacccctgggtatggaaaatggaaagatagaaaacaagcaaatcacagcttcttcgtttaagaaatcttggtggggagattactgggaacccttccgtgccyrtctraatgcccagggacgtgtgaatgcctggcaagccaaggtcaagtatactctatgcatggtgttctcttagggctccagaagaaagcaaaggccctcactaccacaaacatggaggatctgggaagcaggagtattttaatctgtttctgcagattaaaatcctaggtccaagagtccaggatgtctgtggacttgatagctttgactataactttgtctcagagagaagtcatttatcatctctgtggtttttggtctagtcttgatttaaaccaataataagcaaattaatttttctgcaaagggatagatggtaaatattttagtctttgtgggccatacattctctgccataactactcaactctgccattgtagcagtaaagtagccataaacaatatgtaaatgaatgagctggctgtgttctaataaaactttgtttacaaaaaacaggcagcgggccaaatttggcccatggatcatagtttgccaactcctcatttagacagcttacattagtgataaaaaaatgatttagatttgcaacatcatctcttattttttctttacaatttagcaatattttttcattttcctaaatgaaatgtcatctaaacttttttgttctcttccccgccctccttattttaagagctttgtgatattccttgaggcaactagaagcatagtaaaatgttgcaaaaccagagttataaaatcagtgatctaagttaaacaaacaccttccagagagttatactgtccctgatattagcccactgagtaattcaggtgatttaatttgggggtaactcttaatatttgactcatttttattaattctttaaatgacctgagatatcagaatggcatgaataacttgatgatcccttcagccaactaaatccaaattccctamtttctatcctcatatctccctcccttaagatacctacactccaatttcctggctttctatagaattccagggcctatccttaaattaggccactagaaaggaaaaaagaattgtggtgctggtggggtaaatagaaaagattggattccacacagtcttgggaactgatatctgtgtcttgaaactcattctggcccaatatggaatcacagaatgttacagtagcaaggagcaaagcatctggtctagatttttccttttaattstaaatacacaggagattaaataattttagcttagtttggtagcagaatcaggactagaatcccattctcccagtaaacaggccatgctccttccaccatttgaagcagcccaaatacctcattttgcaattttgcagagggcaaagctgacacccagagaagttaaaataataaaaatagtgttatattacatttatataatttacatagcaatataaataataattaaagagatgttatccaattctttttcagatgactctttagacttgttcatggtataaccttgtcactccatacttcattttacaatcttttaaaaaaatttgcactctctataatttgctcttagtctttgtsatataacaagggyctcaaagataaaatgctaatttttaatggtgtcatttcaaagttagaattcgggatcagaaatatgtgttttacttaacccccttccattcacatgaaatgtctttatatggtctctttagagaggttgaaaatcaaagctggacatatgcagtgatgcacatagatgctgttctctccataactaaaatgtctctacctcttttatgcctgtgaaaacctctagctggttatactctgcatcactggtacaaccttgatatgaagacwcactaagataccacccagatgtcactagaggatgttatagacttaaaagttttctcatataatcattctaattcagttaatttgcttttaaaatacatatagcatgtgaatttttgtgtatacacatatatacacatacacctatatatacacatacacttatgtatgtgtgggtgatgttgaagaaacatatcaatattatttcctttagaattgaatgaggttatggtagacgataaatctcccaaaggtaaaaatttatcttagatgactctaaaactcagtttagaccttctgatctttctccaaacacatatcaccaaccatgtgattaggcattttgttaggccagagacaggacaataactgtactgtgtatcaagctctacttatggttttatcaggtctctcaaatgttacatttatttgaaatattagaagaaattgaactatttctgmtctttgacattaacagggggaaagagaagttgtgttttgtaaaacaggtgaaatagagagagaatgctatccaattatttcccagataaccctgcagcaatattaccagagtatttaaagaaatttgcttaagaaaataatattcacagataatttagcagtttaattatttttccaaataaagctcatttattcattcatttattcaacaactatttattgaacaccaactgagtgtcttaacattgtggtgagtaccaggaaacaaaatgaaataagcctctacccttaagcagtaaggaatgctaagaaggaaacaattatagtacaatgtgtgaaatacttcaataaaaatttacacacatattgtggcaatgaagaagaaagagggaaagcttctaggagactgtgaatcctaagggataagatagaacaaaatccttttgagctctgtgcttttttgcataacttggtctaaaaaaaaagcaaaggttttaacatcttccttatctatgtgtttttgtcattttcrtaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaaggtagagtggcatctgggcaaagagaaagcaatctgaagactgtgctataatgagaataacagtattttgcatttgacaaatatgcagtgacatgtaccacctctttaagtcttctaaatcttagttcttmaggtgcctggtctcagacaaactcctggttgtctgttttggtttgttttatttctcactacaccaggttgccctcataggaggataaatatcattgtcataaaaaaaagagtgattttatttctggtgtgtgtaaaccttggggaacttgctgatgatggaagggggaaagttatacactttagttgaggatataaggtacatgccaacaagaataaataaattaaaatgcatggtcacattttaaatgttagcaatagtcaaacatttattggtggccacttcctggcacttactatgcacttacgttgacatacatttttaaatatttacaatgacttctgtgaggtaaaatgttattatccttattttgccaatgaggaaatgaagaatcagagaataagtaacttgttcagtcatacagctaatacagacgggctgaaggcagaaatggttttgcagctgctccacagcaccatgtgagacttgtttatttttcactaatttaagtcagatcactggtgagatgaaatctatctggcatgtgatttcataactgatagaggatcatctctgtgagagtgttctatgtgttctttgatatgctcattttgagctaataggataaaaaattttctgggttgggcatgatggctcatgtctgcaatgccagcactttggaaggctgaggcaagaggattacttgaraggagtttaaggctgcagtgagccatgactgtgccactggactcaagcctgggcaacagaataagaccctgtctaaaaaaamacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgrtatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaatgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactackgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattygtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctcttattttgaaataaaaaagatacccactttttatttctctctctgaactcacttagatgaaattacaagtttgactacatagtacgtctccagtgacataatccactgtttgttacaactgggtgctttggaaagaagttaaatgactcacggtagaatcatgacttaagagaaaccaacagataaaattctaaacattattagtcattctaattgcaatttggaaaagaatagctgtgaatgtatcaaaaatatgaaaggactagaagaaacatgaaattatttctccagaattctttcaagttattaaaagaaataacaaacttcatgccatttttataatcattttgaataaacaccatattttgagttcagggccattttggcaaacccagggaaaagctcttgccaaatagcttggatgttcccaagagccatgaatatttcaccatttacttctctggacagaccaggaaggaacaatttactaggcagtgaattttggttttacgaaatattggcacatgccccaatgcagtgggcctaacacatacttaaaaatatctgatagctccatgttagcatttttcttgttttatatttcctaatggagaagtattttatggaaaattctgaatgcctaattctcccaagttcatatattctcatagcctagagatagggaaagctgtagacaaagacaaaatgattatgtgtggaataatatttacatggtcaatgcccagataacaaggtttttcatatccaagtacttaaattgttgggagagactacagagctttaagattttattatctctggcttgtatgaactgtccccaccaaaacatatacatgtattttgcatttggtacatgtaaagaaaacttgatattaacctctctacatgtaccatcattttaattttttaaaaagtattaagctcattctatcgacacagcaaaccactatgacaggcattgtaggggagagtatataaaggaaataaaagacacttctctggcttattcaaatacatcatctagttgcatagagaagacaaacataagaagcaaatagacactatgagcctattaagcctaacagattacaccctgagtagtaaagaaaaagacaattagatgagtagccttgtgggatggaatcagactgtgaaaacttttggagatgatttaacctaggtcatctgatattagatgtgtatgaaggcaacctgtgcagaactccaaagaagagaggactgggataaggatcaataaaaaccaggataaataagagctttatgctcaaattcagggcccagttaagctttctctgacatacctactcattttccctaccctctctatatagtctaataatgacttatccacctccctccatctcctgtaccatgcccataaatccagtgtatgtgcaaggtcaaaacaaataagaattacctgggtagaactgatgatgtgagggtggggaaagacacaaaaacagatacaatacatatccctaatctccaaatcgtgaattacagatggtagtgaccagattaaaagtgggtcacctttggaaatattatagaagacgcccatgaggaacaggattctgacttgcttagggtgataggagaatgacactggagtggggagaagacgggtaaaagtatgttgtatgtgagaaattgactaatggagagatgagacaatcattgaggatgtttggacaatgacaagagttcaaagttcttatgcgatggttttatttttaccactggtccacatctaaaccacttctacctcatctgtactttcatgttttacacttagaagaagcttctcaatgtcttaggaatggtgtgcagttaatttcataccccacctgctttttattgacaggaaatttggtaatggctttaccgtcttagttatctccaccttgtattgaagttccttcctgctgattaaaaagactttctgaaagtctggaatgtggcaaccttgtttacagatgtgacaagtaaaaatgtttaaaaagcttttcttttatgaatagactgggagaaatagtgacaaaggctataattctatgattgcaatagtattggtacatagtaagcattctatcagtatttattattagcattataatgaaaatatgatatactatgaatataatggtattaattactaatattaatttctactattctctaatgctttttaatactgctcattacctctttagaaattgtagtaaaatacacataaaagttactctttaagtgtacaattcagcggcattaagtacattctcattgttgtgcagccatcaccaccatccactgctcattactttttattgcagctctattttctacccatacttgatgctcttcccagtaggtggcatgtctggttcaactgtacttagccagagttctgaagacattcacatagaggtcaagctttaattattcaggctaaacaaataattgaacagcttgcatggacttttttcagtgggtttaactgacctaattatgtttttctcagggrtagggactattggcattagtttacatcctgagcccacaggcctagtataggattcagaaattatcaaactatccacaaatttgaagatttaaataaaatcaagtaaaaattttctctccaaaaaaaaaatcaattagttgccaatgaaggagtttaaatgggagaggtaaataaattgtgccagaaaataaactagaaagaacagtcagcatgctaggttatagtagatattgtgaaaactgtacttctctgcaatacacaaagtaggttattaaaaattattggctggtgatgatagtgtggtttcatatttgccagcattatgaataatcttctctgcactcctagcagctagaattttaaataaaaagttatcatatttcttcaggtggcaaaataattgtgaaacacaatgttcttggcagaaaataaaacccaaatgactaaatacaacatatttttaggcatgtgtgaatgaatatatttctctctcatcttgtccccccaagacttaaggctgcttaaaaaaaataaaaaatactactagatgacatatgttagaagtagggaagaaagcaaaaccggaggtagaaacataaacaggaagcagaaaaaagctaacaggaaaatgcatatcataaagctatcgaccttgctatgggtgaacttgggtttaagtgaactttttaaacagccaatgcacaaaaaaaccttatcagttataccatatggtgtccccaaaaaatgtacaaaaggagcacacttttattgagactgaagttaaaaataaacttctcccaaaggtccgcagaaagaggtcactatgtaatgagcagaatgcctctaacaagagcacattatataggctgctttctgtgcagaaggtgctgaggacttcccaccaaagcacagttcagtaaaaacaagtcttcagaggccactgctgtgtggtccatgtgcaggggctctttgctggtctggcttaagccaaaggtagattttacagcctctaaaaatcattttccttcaggcaaaggctcatatcataaatactgtttctctaaggcatgattttgttagctactctgtgacaatgagctcaagattgtgtattctgcaaggtgtaacaactgcatttttacaaaattgttatgttcttgcacaagattctatcataagcaaatggcaatagaaggcaaatgtttcagaacaattaatgcaaaaaaacgtaaatagagaaaattatt

SEQ ID NO: 12390 - DNA, 230097 bp, Homo sapiens
aacaacaatattttttgcaagacaatggatttgttttctaaatctagattttcacacagaatgtttccttaagggcggtagaacctacagtgacttccattaaatagagaagttgtttcagagtcttccaccttcatttcttttttcttcttccagtgttatcatccctgcctaaggagacactgtctagttaccctgtctgctcactgccttctggtgccaccaagtttagttctgcctctgtgcctttgttcatgctgttcctgtgattgaaaagttcttgttgaggcccaactgagatgccgccttcttcccttcccaatgaccataactactataaaagaattgacaataccactcatctttgttctggccccttgacactcatggattgtactatattttcatgtgtaagtcctgtctgcctgattgctctgtaagttcctttggagtaggactgcaccttgtgtttcatttctatatccttttatgtctgatgcttttgtgaaatatatttgtaagactttaggaaatgaatgttccatctctcctagcctgattattggggtccaaagttctggaggtgagtagcattctggagtctctctgcagggctaatccagcccctccctgtggggtgcttgttaacaggaaggacagatcacttttgtactatgcagactcaggacccagcactcggtggcctccaagtttcatgaygttgacctaaggaagtcagatgttggctgactctcctcctacacattctctgtttgcattttctacaactggcaagagaaaaccgttctatgggccaaatcctctccttagtttcacttggcctatggcaaaaggtccaagaagtgatgcacctatagtttaaaatacaacttatttttactgtcttgaaagagctgtctccgtaaactcacttggtaggactatttcaccatgaaagtggcttcccatggctttctttgtctctctttcttttttcctctctgggtgtctggttctgtgaggtttcctttacaaatgtgtaggcattcgtttctctgtctccacctatctctgattctctcccttttaaatttattttccatcttttaccttctgtccaaaggaaaaaaaaatcaatggaaatccataaaaggaaatagagttacctaaatactttttgtggagagaattaggaaatattacacttactcatttacatggtttttatgcactgaaactgtttttcagaaaaataaatttgtcgtttcttgtctacaccactttatactcacttatgaacctcaagatatgttcatacattgtctatatttgtaatcaatctatgtacgtatctatttttaacctaacattgttttgttaggttttatattactataaatagtaatatttatatgtgatttgttgagccattccctaagtgtttgatggttgaattatctctagtttcattattgtagacaacattgctaccaacaactttgtacaaattattatattttattattctggctttttctgatgtacattaccaaaagactaccatgatgtaatcaaaggcattcactgactttaaaaactaaaaacacagagcataaaactctattaaaaacaaacaaataaaataaccccttccattttgggtaataacagttaagagaaaggcaaaagacaaagaaatgggagaaaattattcattcataaattcaacaaatatttgagcacctaccatgtcctaggcactgttccaaaagtatgggatccatcagtgaataagaagcccccaaacccctgcctttgtagagccaatattctagtgggagaaggcagacaataaacataatagtaagtgagttaattatataataagttgaaaggtgatatgtgctatgaaataagaaaaatagcaggctaaggggaatcaggagtggtagaggaacaatagagctatgtgggttgcaatttcaaacacgggttgggaataggcatcactgagtaggaaacgtttgagcagagacttgaaggaggtgaggaagttagccttgcaagtactgatgaagctgcacaacaggcagagggaacagctactggctaacaatgttggatatcctggagagacaatgaggaggctggtgcggctggagcagtgagggtgggctcagcaaggtcgccaggatccacgtcgggtagggtcttcgaggcacttataaggacttaaacttcaaggaggctgtggaaaggttatactagattcactttctttgaaaggacagatgctggacctgtccttaacccctgaagaaagtctctgggatggaaccagggaactgttgtatttcagggtggttctgttgtgcacgtggattcaggactactctttctgttcaaaagtcccacaattctaaatataaaataatttaataaaatgaagcaaaaatttcacagcattctcgaatgttggtgatttagagactctggagatcatctaggaaattgaagcccaaaggttaagtgacttgctcaaggttacacagccacaagaggcagaactcggtttcagattcactcgtctaaccctgaattcaatgtaccttccactgtactggactgcctaataaacggtatcatttcacttatcaggtggttagatttccaatagctccaccattaggaacacagtttgaatccagaagctctgtaaggttgattggttgattaaatatttggttatctaaaaatcaatcagatagctgctattgttttaacctttacagctaagaatcattcaaaatgtattaatcacattttctgcttctctagaggaattctgaagagtcatgccatcttagaattggaagggaccttatttgttcaggatcttgcagtgcctgtgggccataattttacagttagctcttatttaatactattataaaacacacaagccattcaggtgaccctggacatattggaggttttgttttacaatatgtttctgatttagtttactttcttttgatttgcttcttggatattttctgttgctaaatttttctccacttaattatttttttaataatgttggtctttctggccttattctgtaacttaggcctaatttttatcaacagtgtctgagcttgtagtctttgctgtcacctgggatgcattgaagtggtcagtggcaattggttcagaaatctcttctgtgggtcagaactcaggcttcagaactaagctgtggaaatgatttcagttaaaccatttcccctccacttgcacacttctgcaagtttcagcagccagatctgttccagcaatgggggcaggttgcacattcccactgagaacacttggtggagattataaggacacattatttttttctttcactaagccagaattggcagttgaagatgtgtttgagctactgtctgctctgggaatgggaagaaaactgtatacctagtgcatttccccttctatcttctattccaacaaagaagttgcagtcaatgaaagtcactggtcctaatatgaactgttcagttaacccactaaagcagcctagtcctattcactagctaccttgaggtcacctactctttcaaggcttaattattcttattttttaatgtagaaagttcaacctaaatttgtttctgggtgacttctagcttcatgattcagctcctaatgttctccaccagaagattggttgtaatttctgtttcatcacagtcttcttgcctttcaaagcctcagtgagtgactggtgcttttttctgggtggtttcattgcattcctagagaaaactctgaaaaagtagacatgtgtcatgagaatatgcatggctgtaaatttcagtatgtgaaggctgtcattgatagctccatgaaaggtaatgactgaaatgctatatgcattatcacaggtaagctttaggaatcattaaaccctgacttgaacgttacatcagggactagtatagagactagtgtttttgcaatttaactctgatgttgttttcccaggtcctaaattgtcctttggaagtagagcagatggttgctatgaggcttagttttaaatgaatgactgtccccatatctcagtctcagccatttaatgtggtgttcttacaggcatggatgggacaaggaaacatggatctcagcagcctggaagggaactgtgggtggaggctatgatgccaggaaaggacttactcctccagctactgggagtgctgccagcagaaagcccttggctcagctgacatctcctaggggcagtgcctcagctgaagagagccaccttgcccaaggtcgctgaggtggcctgcatgtaaagactggtccatgctggggtataaaggcccaccagaacaactcagaacccagccccaactcagaacaactctgaagcatcatcccaccttcagaatcctccctgcagggatgcctgaggcttggtcaatttctccctctgctcaagcttgcctccctccattccctccctttatttcctcccacaaatgttgactacaagagcacttcctaaaaagcctccctctgcctgctaaacaccatctcagaatctgcttctaggaggacccaacctgtgcagaaattttatgagcaatttgcctgtccattaaaaaatacagcatagactttttccaggttagctggagatggagtttttttgtatcaaaaaaagagagctaaactgagaagagaagcaaaggtagaagaataaggttagactctccctgtataactgaatttgggattgggaatgatatcttgcttctctatgaaatttagaaactgtcttttgaagtcttcatccagtcacatccaagagtggtccaggaagaaaaaggaaaataagaatgaaaaaaaaacaaaaaacaaaccttaaaattggatacttctttgtgccttgcattaagcctctatgttactgcccttgtccgtataagcaactctagataaaatcctttcttagaccatctaatttatctccccgtgccattgtgaaaatcgggcaggaattactgcgggaaccagtgactgaatgggcagtggtgtctcgcagctgtaactcagagtttacaagggaaggatgaacagcagccatccttctaaaggcattcttcctctcctccagcacagctcagtctgtgcatgcctcaccaaggagaatgagggaaggccttgttgactgcccagcccagagtgtgaggaacagcagttgacatgggcggctggacgggatagaaaccagcatgaacatttagtgacacctaaggaagaggtgaaaatgggggagaaagccaagaaccatcagacagcttctttctgttcttgccttggatcttaggggaacgtatgtgttcaagggtgccttcctccgcagggcctcccatcccttggcacaaacttccaaacgatgagtagacatggaatgggcttcttctgaagactgggtcaccatccaactcagccttcggagtaggcggtggggctgggggaagaggacggaaccatgaggtctctccatcacttcccgggtgtgttgagaggcaagcaaatgcggtgggtgggcctgggctgtagggcccctgccatttcgggaggggcctcctggtgtttagctctgggatgtgtgaaaatgtgttggtgaaaagcgagaggcttacacagcccttcaggggaagaggggctggggcgctgggggcggcgtcgggatgagtgcagaagagacgaggcctctggacagcggaggaggaggggagggcgccgaggcgcggtgccagctgccgcgcacaggggccccgcggcggagccgagccgcgggcacgctctgccctgtcgggagagctccgggagcggcgggaggggcggaggggcgcagtggggcccgggcggctgcggccgcggagccggggcacctgaggaggaaggagggtgggagcgagggagggaggggacgggcgcagaccgaaagtggggaaagaaggtgcaggcaggcgggcaggcgggcgggcgccctggcccagggccgcgggtgcgggagcccggcgaggtcgagctgggcggcggcgggggccgcgccgagggaggaggggaaggcggaggcgcggggagcgtgtttggggcgccgcggcggggagggtggcggccgctggtgcgcgcggggcgctgtgtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgtccgccccgtcggcggggctcgcacgggtagggggctccggcggagttgggtgaccgtgaggcggttggtttggagaggttgtcactaaggaggagtttacttttcatttgtggagatgatgggagcccaggaaatgtggtcagaaaaaggcccctggaggggtcctggaagcgtccttagctggtcctgggggactgggcggggaagggagcgcagaaggaagcaggtgggctggcctgttcctccttgagggcaggaaggctgtggcttggtttatgcaggaagaggggtggggaccattgagagcattcggtggccagtcctgttgaatgaaatctgagcactgagctggatttgcgtgccttgtaggtgactggtgcagttgcagcaccaggatagatagtgccccrtattccgatttttacctgggattaccagccaggctggagtctcagcacaggaaccgagcgtagggatttgtgaatgaatgagtgttcgtgttttaagagatgtgggaacggagcagagtggaacctgttgtttgtcactgtaacgtttctctgggttggctgcatcctagacagaattgagagaaccgggccatgagttcggagtgtcagcagagccaccgtgaggggacgtggtttccagtgcagtacagctgtctgaggatgattctgcacatacaactgatcttcccagagagtgggattttgaggaagtggaaaaaattgtttagatggttaaagcagtcgctaaatatttatttcttaaagacagaagaaaaataattatttaaatagtgtcctcccgtatgttctcaaagtaccgttaaatccaagaggcttttcattgtgtaaatctgggcactgggtcttttttcctttcagcaaacaagataacaatggcatatcctattgtacagagagaaaaaaatactcctaatgtcagatagaatcacagcctttacctggtcaataggttaccaagaaccattccatggattatttgtcaaagacacatttgtatttttaatagttaaaaacttggtcttcattggatgaaggcagcccacagtggaggagtgaggagaaggataacatgttttggcttcaatctggaagtccaaaagttttttaatgaacctattttttttttaacagcatctgattgtttaacatgaagcttgactgatgtttgcttgtggttgcagtgtttctctggcagtaatcataatcaccattatagtaaaaacatcgtttattgagcacctactatgtgccaggagtaagctttctctcctaactattgaatgttaacagtgtgatcttagcatagcatgtctgaagactagagtctaggatttatgacagtacaaacctaccagttgcccattcgttacagaggcatgtgctgaacgctatactttgcttttgtcaagctctctctctctccccctccctgttcacacaaagttagctttaggagcaattttcagggatgaaaatgttaaatttggtgaaaatattaagttgggatattatcagtaaagaccatccttttgcctgacggttgaagacctgaagcagtagttcaaaattgtgacagctcatgaactttgtgatactttttttggttgctccagagaaattgtgaatttttgttttctagaatatctataatctcagtttagtacttggcaactctagctactccatgtttgttcagtagaagaaagaatactgaatgaacccattctgtacatttttaatacttccctcaagaggctgcttagagaccaaatgaagtaaaaactgaagggacaatgagccccaattattagcagcttgtataaacttgtattaatctcattgctacttggcttaagtattaaaaggcttgacctgggtaggagtttaactcattttgctttatcaagaagattcccaaataagagcttaattcactctaacccattactgggaatgttggaaatgaaaccsctggttcattgacttaacactactttgcattgtgtggatctcagaaagtatatatttgaagtgaaatttgagaccagagttatttatgcaaatcttacagaattattatcacagaactgccctaatatatttaatagtatccttttaggcctgtgactcggtgttgtattgtcttttctcaatcgtaaagttcacatgttctgtgcccttttgttgctgagataattttataaaaactttacattcatttttttgtagactaagcattctttttttgccgtaagagtttgagatagttgctaggcacgtggtggtgccccacccctttccaaagcacacaggtggaaaaataaaatctttaccatttggtcctgtttacagtggtggaaggttgtaatagtttccaccccctccccccggccattttacatcaattatgaagtgtatcctcattatctacttggcctctggtattccccagagtgcaaaaatgtgtgcttgatctctctctctctcttttctagcaataattcatctcattaagcttttagaatgatgaggcattatgatgtcaaacatgatgtcaacaggaaccttcctgaatacctaatttgcaaaaaaaaaagggttataagcattaataattcatatgcagtacaatgatatcacatgggtttccatttctggtaagaagttagatttgtctcccaattgctgtgaaaatgcaacttcctagcaatttctttcctttttgcttgccttttcaaaaatagtactccaacaggagaatcctgcaggatgttcactcttgatattgtgccagttttgtaattcttgttcagaaatcctcagaggagatggttgaacctctctctgggaagaaccagggattcttacaagttttctcataccagctgttcctacttgggagcatctgggactagacagccagttgtagagaagaatcgttattgacaatatcgtcaacttgctatgacctctgtgtaggttcactcttttgtggatcagacacaggatgttgttagtttccagatggcagcatcaccagctccccgttttccctccattcatacagaatgtgctcatttgttcattcagtatttgtggccagactgtgttgtaggtgctagcgattcaggaaatatccatgaaatttggtaagcaaagcctaatgaggaggataaatctcctgtaaaatggtgtgcctaagccagttattagtgactgctatgttttctgttccatagcactccagaatttgtgaggataatcctgagttgactatatataaaaggaaaataaatagatattccactgaccttatggtaaataataatgagattttatttgggggaggagtagagctattttggaaaaaagtcatttttgttttctaagtcagtgttttggagtcaaactttacgcaagaatcacctagagagcttgttaaaatatagattgctggactccactcccagagattctgatttagtaggtcttgggtggggcctgagaatttgaatttctaacaagcttccaggagatgctagtgttgctgatctggggaccccattttgagaaccactgctttttacagtggtgaattaaattatctgtctgttgaccaggcgaatgaggtggggccacctctagcagagtgcatagtaccacactgtctttatctggggtactggtcatagcactgctttcatcttagttcacttctgtatgggaaacctgctatccctgtacaggaagtcaaaacgctgagcctccgagattggctaaaaagtctgtaagtgaggagtgttggatcatgtaaccaactctggtttcttgaggttaagttttccccaggatccttttgggtttgtacaggtcctaatgtcttgctttgccaccacaacagaagtctaaagcaaggctggatgttacatgatacaggcacatattctcttctcagctcttggaattcttgctaggcctttcaccatcatttttcattttaaaatgaagtataaagtttaataagctcaaatgagtcctgcaagctgatttcataaaatccaagtttgccttctgccattgtatatatgattacaatttagtcccttcttttcccagcacattaattagaatgaatgagcacattttccttattttcatgactttcttcagtagttccatgaatttttaaggactatcaggtaattcttccttttgaaggaaagtaagtcctcaagccaggatgtaacatagtataagctgccagctgttcagagatgatatagtttctactgaaatcctgttttggtgaccaccaggtatggcctgggcgccagcaggacagaatatgctggtgagggcagggcagattctgtggcactaaactggtcatgggtaaaggccagtaatcaaaataataatcaaaataggaaggagggagtgagccccgtggaaccaggtgggaagacagagtccagagtttgttcaaccagcaaagttggagggggccagggagcaggtgggaatgttggggccaggcaggcaagggaaatctagaaattagtggttcagcaaaggtgacagctgttgaaccaggttgagacttctgattggggaataaaagctgcttactttctattctattcaggaggctgtggtgaccaatcggagggctgtaggtaactttgtgaacccagcaccaaatgacacaagaccaaccaaccagttcttccttgcaccctgatcagacagagtctgggcaggaaacagactgcacatccaaaagggttaactcagaataatcaaatgaagggactactgcaaatgttttggcaggatgaaggaaagacaacaaatgatgctgaagcaccctaggctagaaaaagagggagctgttactaccccagaagagtcaaggggaggggatgtgtattagtctgtttcacgctgctgataaagacataccagagactggttaatttagaaagaaaaagagatttaatggactcacatttccatgtggctggggaggcctcacaatcatggccaaaggcgaaaggcatgtcttacatggtggcagacgagagaatgagaaccaagcaaaagaggttacccttataaaaccatcagatctcgtgagacttattcactatcatgagaacagtaaggggggaactgccccatgattcaattacctctcaccaggtccctcccacaacacatgggaattatggaagctacaattcaagatgagatttgggtmgggacacagccaaaccatatcagggtggttatgggaagctgagaaaccagggtagttatgggaatctgagaaaccaaacctgtaagtcagggaaaccctcagaagctgtagccttcaggagtggacagggagggagccaaagcagtaagtcccttcatgacattgtcctccctttcatcaagctcctgctggtttccacatctggaaaccagagggaaaaggaatctgttgattggggttttccagggtgctgagcagggtggagagtgggtctggaggggcaaatgaaaaatatcctgagcatatcccaaaggctcttcgtaacaggcaataagagatgttcagtgtcactggagctacctcggtatagataaactaaaattgtgatgggcagtttgatgattgtctaaaataatggcattttaaaatggccacttaattcactgtttacagttcctgtttgatgactaatgatattaaaatatgtccagttaycttggttggagacctcgaacttattgctgtaaacatatccttctcttcagttcattctgtcccctgactgctgatacactttttttatcacttcctctgtcccctgcctgctgtccttctccctatcctgaactcaaagcccaagggtggaatgggggagaaasacctgagcctcataagagactcaggaccctgtcttatcagtttattccattttttttctcagtttttactttcccactttctataaccttctctccacagactcaaaaagtgaaaaaaaaaaggattttgctatgtgcttgtaaggttatattttcaataaagaatgtgtacatttagaacatatttaaaaatattaaaatgtgtccaggaatttatttttaaagataggtgttacctttaccctacagtggaagtcttggtagttatgttttagtagaaaacaccaattttttttttttttgagatgaggtctcactctgtcaccaggctggagtgcaatggtgtgatctcagctaactgcaacctccgcctcccaggctgaagctatcctcctgcctcagcctcccgagtagctgggactgcaggtggtgccaccaccctcggctaattttttggtattttctgtagagatggggtctcgccacgttacccaggctggtctcaaactcctgagctcaagttatccacctgccttggcccccaaagtgctgggattacaggcgtgaaccaccatgcttggcccaaaacactacttttcaacaagttgtagtatatattagtttaaaattagttgttcatggctccttccctagtctctttttttcttccatcagcagataatagtcaactcttatttaggatttttctgttttactctttaccattgatttctttcatcccctcctttccccctccttagggagaatgcacagaaaagtagttcctgaagtaggattagcctaccctgctgcaaatttgctttaagaagcttgtgattgctgtaataaaaatcaaggaactattttgcttttggataatccatcaatgaaaataagaatatttcatggttgtctcttgtttccaaggcgatttaagttttagtgcatggtttgtacactttgcaacaaggtaaacaggatagctataataatattagttgttatttaagttcttgctatttgctgagcactttatttacattgtttcaccaaatctgcatgattttccctgttctgctatgagctacacgttattattttcactttagaaaagaggaaaatggggctgcaagaggtgggataaatttcccaaggcgaggactgaagtttgaaggcaagagggtccgaatggtctctcaccccatgagcccatcccttaagtgtgttgcacactcaggcctgtggccacacagcctgaagccctaagtgtggctggtcctggaactgcagttatttagagcagaaggatgataaacaggcagagggaaggggagcagggagcctcgtgagtgagatttttcctttcacatatccactgtcaccccttctattaacttgaactagagtgttttgaagttggagaagaattaaaaaatgcacacaaaatgtgacaagctctggtacaacatgttgtcattattttcactgaacacagtgcctgacactttgtaagtgctgtacaaatagtagctgctcttatttttatgrttgctattattactctttgggtaatcaaaatgagattttggttatttagatttagatatttttgaaacatgtaatttttttaatggaaaatatatccgacactttcaagtacattgatttggccaatagatgactaactggatttatagacagataggttatcccaaagccttgcaaactgctgccacagacatgggttttgtctgcttcacttggatttccagagatgacatagtagaatcttgccagtccaaggcccaagctggggtttgggttccatgactgttgagcctgcactcagcagaatttacaggtcaaggccttggtgttatcctgaggtggttccctgtggaattctttggtataaacttgtagcctgaagcctcagtctctaattgctcttagaagcattttgcatgagctcggttggttttcatattgctgcgttttgggtgctgtcagacacagtatattgttgggaaaatgatacactgtacatctaaaacctgttttctctcaaataggaagatgtaatgattagctccagggacccagttgcctgtgtgagtcataaaactgagataagaccctaaattttggaaatttttataggaagatgcatgagagattttaaagcaacctatcacccagggtaccatatgaagaaaaagatgccgttctgacgtcagaaccacaaatagcattaaagctccggaactggaaggtgatgacaagggttcaggatagccagagcttttgtccactccagggttcctgctgagggagcttcaaacgagagcaatgaccaaatggagagacaaatacatttatgaaggccagtgatgacccaacaatccacacctcagccactagtggtcctggggccttgtgggacatactcattttcagcttaaaaaatggattgacagtcttggccgagaaatggggtctctgcaaggaaacaaaagccaccaatagtgtttggagctgagccttagttggaactagaagtctctttcccccacagtcgagagtgtgatgctcaaaagaaggatggccaaataaagactgaagggagcaaggatcagcttagtctgtgcctgtgcaagcattgggtggatacaacctttcatcccagatccatctgtcatgtgcagcctcagacacacacatgcatgcacgtgcacacacctgctctrggaagtgttgctgggacagaacacctaggcgggtaagttttcaggagacttcctgctctccccctcccacatctataatgctgggtctgtgaagccagtttcaggacccctcctcacccagtagactcttgcaggtcctcctgtccttgtggttgctgccctgcccttcttctcagtcacatgtggagcccagggtgaggtctctgacacccaggctgttctctgcagtgatctggcccattaggactgtcaaaccctgggactggctgactgactgtggagccttcatcccttgggaggaacaggtgagggcaagggagtgtgatccacttagcctgatctccctacgggcagtggtagaggggagttttgcagactttgttgagattttcaagaagggacaaggaggtggggcaaaaggttggaatctcttattatatcaaaggtgagaactttgaatcctaaaacacaaccaggaaatgctttggatgaacgtgaaaggcagtgttcacttttatatgcagactatatgacaaacattagtttgtaaggcacctagttgttattggggaaagactttcatatagaaacatgttatatgtggcatttaggtttctaggttagcacaaaaaagttttagcccattatgtagctggaatatatttacactgttgaaacaatattgctgtgaaagaaacataaaattgaattagaactcccatttcttttgtatgggtgtcctttgggagaagcgggtttaattagaggctgatgaagcagatgagggagaattcgtgaagttcctttagggagtagttatctttagtgatccattgtgtgctggggagctgaggggctcaggtggtgttattaacctcacattgctagggaggaagtggaggcacaggcggctcaagtagcttgaccaaggtcacacagctagggactcagagctacatctgctcaaccgtcctgttttcactgtcctattttatctccaggtaaaaaggggtgtgtcgagcttctttgtggcacttattttctgtttcatctacagatagctcagttggtatcttttaactagaactgtttttaaaaataaatcataaaaccattatataccaaaaatatgacaacttaatatcaatcacacttttctaattgtcttactacttattcttttactgtttgttggtatccaaacagtaactccactcattgcagtaggttgctatgcctcttaagtctcttttaatctgtagcttccccttccagtctctcttttctatatacttgcagtttgtttgttgaggaacctgggttgtttgtcctgtagattttcccccaatctaaagtttacttattgcattcccatgatgcatctaacatgtttccctgccttctgtgtttgctagaaaccgtagtttgatttagaggtttgattggattatactaagttttgtagggtggaggttgtctcttttctgtgatgctaacagaaaatcggagtatgcgaagttttgtaggatgtttggttgtctcttttctgtgatgctaactcttattaacgatcattgcttatatccattagtcattagaggttgtaaaatggtgatatgctatcattttgtcttcatgtattcattggaatgcctcaagaaacttttttcaagagttgactccctagcattctcctaaggtgacaggagttctttgcctgttaatttgcttagtatcattatgaatcgttatgggtttatgtgtatttgatgtgttgatgcattgcagttattaaacctatttgtgcttagactgcccagttttgactgaagggagcttattcaagttggtgaggcacttttcttgaagaaacagttctagctaagttgagtgtgtccttattcgaaactcattgtttgtagatggggactccactgaccaccctgggggtggaggcacatcctggtgtccacctagccctctctagtcatgccaaggccccaaacatcatggagcttttgaaaggaggcatttcacaaggcccccttgcagctcctttgctataatttttgtggctgcaaaagggtaacctggtgtgaaggaaaggtgctcactgactccagcttgaattccagctctgccctgtacaaactttgtsactttggagaagctgcatgatttctccttgcacggtagggataatgcatctctaaaaggattggtacaacctagaggtacagtccctgtaaacccgctaggttctcaagtacgtgtgtgtgtattttctgccttatactaaggcgctactctaggtttggagtgataaaaaaaatgaatatgatggccgggcatggtggctcatgcctgtaawcccagcactttgggaggctgaggcgggtggatcacgaggtcaggagttcgagactatcctgaccaacatggtgaaaccccatctctcctaaaaatacaaaaattagctgggcgtggtggcttgcacctgtaatcccagttactcaggaggctgagacaggaggattacttgaatctgggaggcagcctgggtgacagagtggagactccatctcaaaaaacagaatatgacatagttccacgtttcrggagcttccattgtttgtgccctatattgtcgtcttctgtgggaaggcaatgtgttgactgagtgcyggctggctggcaggagttacggattgggaattgggttcttccaggtgagacactcctactgggagagcatgaagaactgtgagcctgaggggtaagtcagctgaagactgtaaggaaaagccaaggagcagacaactgtacggccacaggcaggggccagaggcagaattaaggtcaggctttctaagcctggagctcaaagctgccagacataaataggatccaagagaactgattaagaaggactctaaagtctggtggagttgatggctgagaatactcttgggtgttatggttcagagactgccagataaggcttgctttgggttgaagctctaaagcagcattacccaatagaaataaaatgtgacccagatgtaacctgcacatataattgtaaaattttttatgaatcacatttttaaaagtcaaaataagcaggtaaattaattttagtacatgttcacttaaccagtatattaaaaatattattttgacatgtactcaatataaaatttgttaatgagatagtttacattctttctttttttattttattattattatactttaagttttagggtacatgtgcacaatgtgcaggttagttacatacgtatacatgtgccatgctggtgtgctgcacccattaactcgtcatttagcattaggtatatctcctaatgctatccctcccccctccccccacccattctttctttttttttggaactaagttcttaaagtctggaatgtattttacaattacactgcatctcagtagggactacccacatctcaagtgcataatgaccacacaagtagctaccatgttggaaaaacggaggaagaaagtgaaatttacatcaaggttctaagtcaagcatttacaatttgacattgtaacttgacaagcatagcacagtagtggtgttggttttttgtctcttagtttgtagctccatttttgcttccccattttctcctttgtattatatgaggctagaagtctgcaagctgcatcttccacattacttttccagatggtttcctcttagattccacaggtaggagatactggcaggaaattggaatgtgagagaaaggaacaggcgatagcagtggcccctgctaagtggcagtggtgctgcctgagtggtgatgatgccagccccctccgctgatcagcatgagtgtgggctggcgggtgtcagcccagggtgttaacagtttattgtctctggatgttactgctttatctttttagtttctccagctctacctccatcttccctttgttcatccataccttctaacacctttgtaaacagttcactacagcggtatctcttcttaatatatataaaatggttcttgcttttctcactggacacttgggatctgatgtcagagaactatgctgtactgtggtcttgtatgtaccatctgttggttctatggcttagcttctttaattttcaacttcttctgtctaaggatagaaaaataaggatagtgaaagttctgacctcatagagttactgcaaggatgatataatcaatatatgtaccattgctagctttgaatgtaacacccagtaaatattgcttattattgataataatatacaagccgatttttgaaggctcataatttaacattttttattatggaaaagttcaaatgtatacaaatgtagtgagaataggatagtgaaacctcacgtgtacatcccccagtttcaacagtaacaaattaagactattcttttatttatacctcctactttcccccatactttgggattcttttaaagcaaatctaaaacatcctcttatttcagctgtaactatttcagtatgtaactctgaaagagaaggactgtttagaaaacacaaccacaatactattagcaaatccctaaattaaaataatttgttaatattatcaaatacaagacagtgttgaagtttccctatctcataaacattttcatttaaakatttttttaatcatctttcaaataagatctagctattgcaatcaattgatatgtttcttaaggatcttgtcatctgtgagttccctttcctctctttctttttctcttacaatttgtttgttgaagaaactgggtcatttgtccagcagagtttcccacagtctggactttgctgattacattcctgtggtatcattaaccacattcttctggccttgtattccctgtatgttggtagttagatctagaggcttgataggattcaggtttatttactttttttttkggggaagactactttataggtagtgtcatggacctccatcaggaggcacatgatgtctggttgtgtctcttggagacgttagcagccactgatgattgttgcctagatcaattaattccttaggggttgcaaaagcctaccattctttctacagtgcttctggaatgcatctataaagataaacttccctccatccaatagttggttatcctgaggtacagttcatatgagaaaggcagggcaaatgcttgattctactcttccatttgccagttttcaaaataatgagttgatttcctagcatcctccaaaggtaaccagtgatgatttttgaattcctataaaattatcagtttataaatattagatgtgtcatagtccattgcagttattgtccttactgatgctcagttgtcctgactttgtctactcagagtagccacgttggctcctgtgtccttttcatagtctgctagtaatgtttgacagatttcctgcctttttggactgactagatgttccaggtttgttgcgtccattccctgtctctgatctagaattagtcttttctcccaggaacctaattatttttattgaaaaatggtatttagaggtatgatctcgggtgttcattgctaatggactggtcattgcttctggactttttaagtggacatagccaggaaatagatacttttgaaagataaaaatgtaccgtgagtgtatacttattcatccagtttaaatttaggactacaagccttttcttcaacctcgtcagtcttacgtttctatttcctctttcccatgacataaatcctggttcttaacatcatcatgataattcctcatttgttagatcccacatgcgcgtgcacacacacacacacacacacacacacasacacatctcagaataccagtgatcaacacgacttcatgatcaatatgaacactgaaaacagtttgatttttttccagtgatttttgatwttagggtctgtcccactaggggtgagcaggcaaattactgtgtttataattgtttaaatcagttcytttttatgtggctattctactaacaatggaccagttagtgattagcacaatacagttaggattatttatttcattttccttttgatttggtcttctttaatgtttagtttagtgttataagaatgtaaattatttatatgcatcaacgtaaaatatggtatattcagagacatttagattttatctctgtctcttacattctatgccctctgccttattggtaattacattttaaaatgttatgcatttcataccattgtttaaaatacacattaacatatgttctgcagaactcaacttttctgcattttccttttttcacttaacagatatcctggagatcattccatcgtagttcataaagatattcctcattcctactcatagctgcatagtataccatcatgtggctgtactttgttttattcagccagtcccctattgatgttttttggggggattatttccagtaatttttgctattgtaatggtgatacagggaatggccctatgcctatatattttcatatcatacagtctaattttttagtacaatagtgacataatgttttccagaaagaatatatttatctatccagagcattaacttctgcctatcatacaaagactttccttggactctttagttgtttagtaattgtaaaatagtaatatagttttagctgaagctcaagcttaagatctctagatcttaatctcagaggattttctttgagtaaaatgtacttttttctgctttcaacccagctatagtttcattttcatggaggtgtgagatctctgagacaaattgtttagaggaggtttgtcttgcatctgttggacattgtaattctcctcccttatgatggcagcaaagtgatttgagaagaatagtggctgccttttcatcttcacttctgcctttccacttacattaaagtcctatgcgtttacactggcattaacccagtcagcacccacaaaatgccacagggggctctgtatcactgattgttgtaaagaactttcttgagccttcattagagcttagagcataattgtaccttattttggtattaatcaccaagacctaaaatcaagtttttttccaccttagaaatggaatgcatagatgtatattcttttgtatgtttcagaaattggattttatctttgtgatagaatcacatatctgatccataatgatcctgtagtgctttcttatgttcaatataatttttaaactgaccttgtttttttccttatataaatgtatcaactttatcaactagcaatgctcaaggagttttcttggctcacaagttgtacatgaatgggtgagatcatacctctaaataccatttttcaataaaaataattaggttcctgggagaaaagactaattcatgaagtttgggtggggcaggagaagaaagactggcagaagcaaaggcacccatgagagagagagagcaaagatgaattagattcatagcaaaattttggaggtacagatgggaaatgaaagatggagaaaatgatataaagagtggaggtgtgcctgtgcatgtccataagagataatcttggaggtggagtatcttaactatgctgtgagccacgcagaatggaagacagagttggttacctgcctcagtttaggaaggggaagcaaggttggggtcaaatatgcagaaactttggggcagactggttcagttcaacaaacatatactgagggcttaactgggcatcaagcacctgcattagatttaagaatacaaagttgagtaggatggttgcttccctaggtgagtttatacttagttggaggagttgaaagggataacacacaagcagatatttacttctttataacacattaccatagacttaggggcttaagacacccacatttattattagttgctctgggtcaggagtacaggcacagctcatctgggtcctgtacttcagggtgtcttacaaggctgcaatcaagatgttggctagggcagggtcttatctgaaagcttgactggagaaaatcttccaagcttatctacatggttgttagtaggattcactttttagatggctgttaggctgagagctttagctccttgttgactgttggctggacaccaccctcagttccttgccacaccgtcctgccccatatagcagcatatttcatcaaagccagcaagagagacagtctcttttatcagtaagatggtagtcatattatggatgtggaagagaggattacacaagggcatgagtacgaataggtgggaatcattgggggctgtgttggaacctgcctgtcctacaagtgtctgctacagttctgtaatgcctgagagaggaagtgttccatggaagcatgaaggaagagcatggaacctacctggcagggaagtggcttctccaataatgcagtgtctggatgtctgagtgtaaccctgaaagacaaatagggattaacttggtgtgtagctgggagaggaggaagggagagattccaagcagagagactaacatgagcaaacattgagggggtaaaatacctgaggaccaccatccaagtagttttctgtgtaaaccatgtgtggaagacatatagaaggtatcagaaatggagaaaatgaaagatgagggtcagattttggagttcctcgtttgtcaggctgaagaatgaagactttatcaaggtgatcacagggaggattttaaacaggggaatgacacagtccaagttgtggtttcattagtatggaagatcaattttagcagcatttataatgatttaggtgatagatgaagagggtctggattaaagtagtgcaataggagggcatacattttaattttacaattaggaagttatttgatatttgggcaaggcagatgtgggagatagaacggtctggaatgatgtccaggttttggcagaacattcttgttaggaagcaggggaaagagaagttgacagagggaaaggaaaggatggaagggagaggtctgtaagagtttatgtaagtttgtaaattaagtggctgatgataggagagcccaactcaaaatactctttaaagagcttatgttctcaatttaatcaatgtaactgtgtaaattttctttctagttaagccatatgttcctctggtaggagagagaatcaaatacggaattcatttttcttgcaaacagttggataaaagaaaaattagtgtcaaaattttagtaaacctagaccaaaggtgggacacgcattcactagttctatccagtgcttgcaatattgtactctggcacgcagatactgctatagaataccattcacaagctataaagtgtcatgtaactgactttttcttgaaaatggagatataattagaaaaacataaaattaaccattttgaagtgcacagttctttgctttcagtatatttactatgttgtaaaaccattactgctaattctagataatttctaacacctccaaaagaaaccctgaatttattagcagtcagttccaatccccacccctccgcactcctacccctggcaaccattaatgtgttttcaggcactatagatttgcctattgtggacatttcctatagatggactcatacaatatgtagggtttgtgtctggcttctttcagttagcatgatgtttcatggttcattctcattgaagtatatatcagtactgcgttcctcttgactgtcaaataatatttcattgtatggatatactacattttgtttatccattcatctattgacggacattgggttgttttgactttttagctcttaggaataatgctgctatgaacattcttgcacaggttttggtgtggacatgtggttttatttctattgggtatatactaggagtagaactgctgcattgtatggtaactatgtgtttaactgaggaaccactaaactgttctccgaagtggccgtaccagtttctcttcccgccagcatgtatgagggtctctatttctccatgttttcaccaacacttgttattgcctgtcttttttattataaccattcttgtggttgtgaagtggtatctcacgtggtttgatttgcatttccctgatgactcattcaaggttgtttttaagaattaaataagctcccataggtgaaatctcaacatgaacttgggtttcagttctctgctagatccaggggccttcagaaaaactatattggtattccttgtcaatttaatttacactgcacctttttagctcaggaagccaaagtacaggcaccacttctcacactggctttacagggatggatgctagaatcccctgtggggccctatcccagagctctggaagcacaatctcaaggggtctgcccagcctgtgcattttaaatttattctattttattttgagatggaatctctctctcttgcctaggctagagtatagtggtatgatcttggctctctgcaaactcagcctccgaggttcaagcgattctcctgcctcagcctcccgagtatctaggattacaggcgcccaccatcaggcctcactgatttttgtattttttgtattttggccaggctggtctcgaacttctgacctcaagtgatccacccgccatctcaaagtgctgggattacaggcatgagccaccagacccggccattctgtgcatttctaaaaggctgcacattcaatgtcaatgcaaagtcaagagttgagaatcactgcctgactccagtctgggagaagaaattggtgggacctggaggaaaagcaagagacttagtctcaagaatcttcaggcagcaccattttttgccaccacaggaggtgctggtgaacacatgttgttcagacctctcaataagaactgagagagttgcttgccatttctgtaagtgcagaaactaagatttcgatttggttcagaagtttagcattaaccccaaatcattggaagcactagaattaaatgtgggccaggtttctggtttgggtgcatggagtcatgcagtgtgtgttggtacttgatatttgttttggtagtttggaagaaatggcggttaaaataatttccaaatggtgactgaaacaaaattcacatgtagttgttttggaatgcgttttttacctgcttgtatgaagccagatacagcagacagtgtggaaattggaaagacacaaagtcaggctacaaagacccagcttaaaaggaagtaggggaaagtgtgtgggaacttcccctttctacttttcagttctttttgctttttacttggattaaacagtcttgctttttagattgacttaaagttcttaaggaaaaactgtttctctttaagctgtttttctttggttacagtggaagtcattgggtttaggtttaaagggagggaatttcaaatcaccttcgtttctgtcttttgtgtgataatcagagaaagtaggaacgatgataatggtaacaatgtcaaaaggaagctgtgtgacaagaggttttgctacgtgttaattcagaattgattgcagttgtcaaagttgcatcagtcccggtcccacgggaaacagctcacccccagatggttctgatgaagagacttcagtgtaggttctgcttacagaggtgtgagcatagataaggaaagacaagggacaatgagatgcctagactagcaactgtatttagcccttaccggccctaggactgtagactgaggggcccctggcataagcggtactcatgaaggcacatgctattgccaggacagggcactgaagcagcgaaggagtgggaaagaagtgacttgacctctctcagctctcatcctgcagtgccctgccagtgcctcccactggtcacatccaacatgaagccagccacaagggaggcttgtgcaggctgcacagatcagcctttcaagacacagagcagggcagacagtggatgtggatgggcatagtggtttttacaattggagactaacttgcacagtaatcaactgttttacagtgatcacattgtatattttgttaattttagaatgtattattttggagaactttgagaaattttgcaagcatagaaaaacatccatttttcatatttaaaaaacrttcctcagtatttcacatttacttatgcaaaagcttcttgtcttttaggttgtaaactttgttatgaagtctcttaaactttgtacattctycttattttcccaatatattagtgcatatcattgtattgcgataagcctgaaacagagagggccacactgtctttcagattggcagagggtgctttaaaaattcctcttttctagataggggcatagatatttgtgaattattcaaaggtgatcacttgcctttaaatcaagttaatcaaagtggaatttagtttaatgtctttcgtagctcatagcttagggggaagatgctgtgtgtttgagacattcacatagctgcatatatcatctccttgcagacatagctgggaattattttgctgcacacattagtgaaatataccaacttgaaatgtttgtgctaaccgagtgacctgttttctgtgtcatcatgtgtgtaattctcttatgtctgagtaaaaggctgagatgaaggtctgtgtctctggatacccgtggggttgctaggaaatgattttcgaagtgctctgtggtgatgcagcaggttgaactttttttgtgaagtgttgtcatggaaaccaagtgcatcattgccttgtctgactaatttatcttttaatgataaaaatttgtaatccagggttaacaaatataaataatacaaatgcaataaaaaaccaataactgtaaagggaatactgctgtaagtagcgaatcctttgaattggaagatgtcacaggagtattgtgtgattcatgttggtaagggcttggcagtgtggggagctaatcagtttgttttccttcttgtcattggagtagggaaaccatgatttcactctgtggcttagtgctgtgggcttttattactgacctcggctcctgagcttataagtaaagaggaaggcgctgcacaccctgtgaggctcagcaagcttgccagggttttgttttctgggtggttgcttagttgtacttctcctttatgacctctcactctgctctctccacctaagagaaggctgggtgacacaatgcaagccctaccattgatgaaggccagtcatatggaaatggtgccacaggcttgctttctgggmtaagcagtcctacatcccccttccccaggagcaggtcctggagcacagaatctgccttgacttccttttcgtggttaaagggccctcaaggagagaaaacctgctcttttgtttattgaggacaaagtcttatagcattgtaagatatcaatggatgctgcttatatctggatgagtagcttactatggtaagctttccaatgaaaggataggagaactgatctgaaagaagacttgattctatatttagtagtttatctgcctccataaggatttagctactggcgtttcagtctacctgacagcccccaaccccctgaagctctgtgtgtgtgtgtgtgtgtgtgtgtgtgtgtgtgtgtgtgtgtgtgcagtagacttttgttgcattaggttaaatatgctcttcagttttagaccattccaaaatatcttttattaatatttccacctttagggtatgtttgagttttttttttttttaatttaaggggaaaaagtttgactctaggcatgagtcctaagataaataatggaagcgagtcaatttaaatcagtatttcactgactggtgtttacggcccaaatctgttttcatgctttcatttagcatatatttcctgagcacctgctttgtgctgggtacttctgatgcacctattatggataaaagaaggcgcctagaggtaactttaaggggctgagagcaaaggccagccagagcttgcaacctgtccagagcagtttcagaccaggaggattccatctggcagccatactgaaatctcactggtgatgtccctgcatttctgtgacttatttcctattcctttggtcattttcccagttccagaatcttgaccgcacctcctaatgacgatgtggtacacgtacccagcattttgcatgatttcctagtattgaccttctgtagggaatgtcacctttgttggtaaaatggcccccagaacctagacctggaaggactgggcagctcttgactccatctatggcattttatcttctgctttgatctccctactcaccctcacccaactccacatgggcttcagggtgagagaaggggccctcctcccctcgttaatatcctagccaactcatacacatgaggttgtatttagttcccagagcagaggtgagtcaagactcgcatgttcaagaggactttaccgarcctcagagatgacagaatagaacaggccgagggagcactctgaaactagaccctctggtttgcccttgggtgctgcagtacttgtctagtctaccagagactccagtctggccttccctacatagtacctttccatagaagtttgacctttatcctctctcctccagattcttccccaagattcctagacccctgacgtccagaccaggtgattctaaatccctcccagggtaaatgttatctttggaagtaagtgattgagagcttttgcttagaattccagctgccaccactctctaaatgaatattatttggcctgttttctcgttcatttaatgggataagagtaattcctattttatctgggaccagtgaggattaaatgagagcatgcacgcaaagtgctcaatgtaatgcctgacacttcgtaaatgccttgtcatcatcatattgttggaaagaccactcttccagtggtctctcacccccaacccattagggctattcttagccctcctggtctaagtacaattatcatggccgtcatctcacagagcagccccacagargcctacaatctgttgtttgtccttgcaccacagctgccctgggcccctcttgtatcacagaataatcccatagccctaccctaccttccttctggtatttacctgttggttgtgatttgtgtgtgcgtgcacgtgcttgaggaaaccccaagttgggaaacatgaaaatgggagcatagactaactaattgaccatatttattcacctttagtatattawtcaattgatgaaatactcagaatggcctttgctgtaaaacgtccagcattttgcctccatttgctgtgtatatttcagcactgggcctaccagtgtatgaacaggattctctgggacatgctcatgtttctccctgttagagtctcattcttgcagatcaaggattaggagactaaacggggcattcattcattcatttagctatacaacaagtaaatgttgagtgcctactgtgaccttgaatcagggaatacaaacaaggtccttacactcatagtgcttatgttgtaatttattcaccattttcattcattcatccattcattcattcaatgcatcttgaaattctgtgttcatctttttgtcaataaggaatattttcttcatatccttctctttttttcacttacaccttcattcgtctatttgtttggcagatattgattgaagtgggggcctaatatgtgtcagtcaatgtttgagacactgagttacagcagaaaaaaaaamaaaactaaaaattcttgttttctgagtacttacattttaactgggggagatcaccaagaaaaaaaatttaacaaccttatttggttggtactataattatccccatttaaaagatgaggaaactggagccgagatagattaggtaatttatttaaggtcacaccaccaggaagtggcaaagtcacgattgacacccaggctggctgactggactcttaactgctgtgctgtgttgccagagaggatattctggaaagataacttttgagataagacttgaaggaagcaagggagtgagccatgtggctatctggaggaggaataccccagacagtgggaggtcccgagtcaggaatatgcttggcattttgagagaagcacaagcaggccagtgtttttgggatggaataagtgagagggaagagaggtgagaggacaaggttctagctacctgtagacacaaatgtgggagtcatcagtgcatagatgacacttaaagctatgaaactggatgggatcatcaagtgagtgagtatggatagaagaagagatctaagaactagattaagacctggggcacccagaagttagaggctgggttgatgaggagaaattcagtttctaagaatgagtagccactgaataggaggaagaagtgtagtgactttcacttgaatgccaagtggaaaaagtgttttgaagaggaggaagtgattaactgtgtcacatgctgctgatagttcaaaaaagatgaggaccaatattggaccactggatttagcaacatggaggtcatcagtgaacttgaccaggacagtttcagtgtggtgatggaggcaaaatcttgcctagagtggttcaaagagagaatgggggagagtaaatttagataactattttgaggagtttttccacaaaggaarggaaaaaaatgaaatgatattggctgggaaagtgttctataatgtcaatttagttcagttggatgatggtattgtttggtttttctatattcatgcttattttctgtctaatagttctattaattactgaaagagacctccaactgtaattgtgaatttgtctatttttgcctttagttttgtcagtttttgctttatgtattttgaagctccgttgtttgctaattgtatatttagtattttcatgtatgcttggtgaattgacttttttatgattatgtaatttccctttttatccctagtaattttctttaatctaaagtttacttagacagatattccctttgtttgattagtattcacctggtttattcttttccatttgattctacctgtataattatgtttgaagtgagtttcttatagatagcatgtagttgggtcatgtgtttttaattcattctaacaatttctgtcttttaattgatttatttagaccatttacatttaatgtccatacttttattatttgctttatgtttgcttcccctgtttttcattcctctgttccatcttttctgctttttctggtttattcaaacattttttagtattcaattttaatttatctattgtgttttttactacatctctttgtgtagattttttagtggttgctctagggattatcacacacacacttaacttttcatagtgaacttagaaacgatattctatgtcttcaaattatataaagaaatcttcatgtgtgtcttttttatccaatcttcttcatagttattttatatactagttatatgtacattgaaaactccattaggccatgtcataaatttttctttcaactgtcaaacatactttaaagaattcaagagaagaataatctactatagttacccaaatatttacaatctattgcttttccttcattcgtgatsttccaagttttctcctagtatcaatttcctttaatctgaaagcttttctttagaattcttttagagcaggtctgttgacaactgatttttaagtcttttctgcatttgagaatgtctttattttaccttaattccctatgaatattttcataaaatatagaatcctgagtgaacaggttccccccaccccaggactttgaagatgatatttcactaccttctgtctcccatggtttctggtgagaaacctttagtcatttgaattatggtccccctgtaaatagtgtaccattttctttggatgctttcaagaatttttcattatctttagttttcagtagtttgattatgtttctggacatggatttcttggagtttatcgtgttttgagtttgctaagtttcttaaatatataggtttatgacttttgccacagttggaaatattccaaccattatttcttcaaatatttctttgtcttctctttctgaaattccatgacatgatkttaagaccttttgttattgttcaggttcctaagactctgtttttttagttcagtcttttctcttttgttcagattggataatttgtattgaatcatgtgcaaagttcactgattcttttcttcaatcattctaacattgagcctatccagttggttttttattttggttattctatcctttagtcatcagattttcatttgattcttttttatatcttctattctttgctgagactttaaatctttccagttggttcaagtgttaactcttgcttattggaattttttataataattgcttagtctttgtcagataattccagcatctttgtcatttttgtgttgacatctatattactgagggctcttcatagaaayagaaccaataggatacacatagatatacagaaagtggtttattacaaggaattggctcatgtagttatggaggcagagaattctcatgatctgacatctgcaacctggaggcctgagaaatctggcagtgcagttctagttcaaatctgaaggtctgagaaccagcagagtcaatgtgtaaattctagtacgagtccaaaggccagagaaccaggagcactgatggccaagggcaagagaagatgaatgtgccagctcaagaagagagaatgaatttgcccttcttctgcccttttgttcttttcaggccttcaacagattgtatgatgtccacccacttggtgaaggtgaatgtctttactcagtctactaattcaaatgctaatctttcccagaaacatccttacagatacactcagatatgttttaaaagctatctaggcatcccttagcccagtcaaattgacacataaaattaatcatcacaacatctgtcaattatcttgtcccatgcaagttgtaattttcctggttcttatgtccaggaattttagattgattataagactttgtatcttgattaaatcttatggtgaatcttgatatttccgttttagcagggaatcaaccctgttgggttcagaccacaatttctagtcagccttcttttgtggttatatcaattacatttttaaagccttttcaatgctctttgaatatgtcccatgtgtatgccacccagtggccagtctgtgacctgaaaagtgatctgtctcataatttagttctctgtaatgtgctttttagtgttagatccatatatatgcagcttggaggtgatgctagcagtacataaacaacctatggcttcgattttccaagcacttccttgtttgcaatctcttggtattttcaagttccctggggctactgatatctggccacctttcttttctctaattctttgtacaataaacaacaccaatcttttctctcctttactggataattttagtgtggaaaataacatctaacctttctgaaatcgaaatccacacttttgatgaacatgatccaattccaatctcttatgcttatgtaactttaaaactttccacacatctttctaacaaacatgggctcctctagctttagctgtattgtaagatcttagatgaggttaaacaccttcctgttcagagctttcattcttgtaataacccaggcttgtctctccagaatgctcttctacttgggtggcttttaaagcatgtttgtttatagctgctcctggtccattatcccctgggaacacaatgttttatagggggtccttgagcagaaaaacacagcagcaaccctaacccttcgacgtcagtctctccaagtgcatckaagtttaagtgttttgcttccttcatcagtactttttctgtgatccttccttttcaacaagctctccagtaacagcacaagacaaaagttaaaatgaagctttttttttttgtatttcgttttagtcattcaattgagagttttttgaaagggcaatttaaatttgttttgttttgttttgttttgagatggagtctcgctctattgcccaggctggagtgcggtggcgcgatcccggctcactgcaagctccgcctcccgggttcacgccattctcctgcctcagccttccgagtagctgggactacagacgcccgccaccgcgcccggctacttttttgtatttttagtagagacggggtttcaccgtgttagccaggatggtcttgatctcctgacctcgtgatccgcccgcctcggcctcccaaagtgctgggattacaggcgtgagccaccgcgcccggccaagggcaatttaaattttaattaaaactccgaggtcacaggaggtctcgtagacaggattctactcatgtagaaagaaagtagaaaccataagataacctagtgtacatctgccttgtcaccagtcagataatcctatgccaacatcttctccatcactagggctagctattaatatcttttcagtaaaatatgctatttaaagtgttatacccacactaattattcaaacacattcaaattgaaattaactaagctgacaattattcagtacccattttatgcaataagtgttgtgaaaggaaataaagaaagaaaaatacataactcttacctccaagaagctttctgatttgcatttccataaaataaaattattttgtctttcaaatacaggtttccaaatacagagggataaaatgttgaattaaccttttgaataatacgtagttgcaactaagcagcgttttcctaaataagcatgtttacaaaacttcctaggaagtgaccagattgctattcattttagtaacacatagtgaatttttttagtgcaaaaatgagggataaaggagaaaaagtgagacagttgcaaacaggagttgcaatcaacaagggagacagcagccaaatgaaaagagttctttttctagagcactcactagtatagcatttttggaagagtggcttttgaataaaacatccggaaaactggttgatacacttactgtcagttcagcacgcacacctcattgcttttcttcggcaagtattgggagtaactcatcattatagtcaaatatgtattcaaatgctttgactactggagatatcatagttcaaagtgtattgctcttgaatctgaagaaagaaccttaattgatgtttaatgtgaactcagatattgagagaagaatgataagacgtcacatatttcaacagatttaaagtaatttgaggaggtaaacaggcataatcattttacttatggcacaaaaacaatcatagtaagaatagttactaatatttattgagcaccacatgaagagcatgatgtgcattacctcactgaatcatgcagcaatcctgtcctataagcactatgatccttatctccattttaccaacatgaaggattagaggttagagaggttcagtagcttgaccaaggtcacactgttactaagtgatgaggccaagtctgggtgccaaggccagttcccagccaccattcctccctctctcatgagatcatgtgttcttcaagcaaagttcacgttggccatcagattatttctctgggaaaatattaaagctgcattgatttgctaaagaaaccacaagtgtctggctaacttgcatttcaaattttgctttaaagttttaaagttatcattttaagaacagctgctgtagctgctataatgcctctggaaaagatagcagaaaaaatccactgccttgcccaccactactacaaacaacagcaaaactttctcatggttcaaatccttccttaacttgtcccaacaccaaattcacgcaaggtgtatgccgatgagcctcctgtaaaatatccagagcttctaatttggggtaagatgaattaagcactccattctctctctccaacttaatgcaattataaaacctggcgagaatgcatggagcaattatttaagaaccttgaaaagtaaatagtaacaggtagattgggagggcagccagaaatggaagaactaccaaactggtggtgtgtttacaattttcccctcactggtatccctcagcctgtatccagtgctctccaagagacctccctgagtccttagttctggcagaaggcacaggaaaagaaaggtggccaaatatcagtagcaaacgtgcttaaagagaagttaacagttattagctcaacatatttcatctacatcagcatgttttaaagtatgtttcaaaggacaatagttgtgcagaatgttaggctcaaatgaacaaaaaagcaaaatagtggagatccagtgctgtttgggattaggctctttgtaaaccactaaaagaagctagatatatttctaatttggtaaaataataggtatgatttggagatccagtttattatggctaaaatttattagtgagactttaagacatcagctccttctgttagaagttttatatcaaaatgtcagtcaaatttctttttctttttttaatttatttatgtatttattttttgaggcggagtctccctctgtcgcccaggctggagtgcagtggcacagtcttggctcactgaaagctccatctcccgggttcacgccattctcctgcctcagcctgtagctgcgactacaggcacccacgacctcgcctggctaattttttgtatttttagtagagacagggtttcaccatattagccaggatggtcttgatctcctgaccttgtgatccgcctgtctcggcctccctaagagctgggattacaggtgtgagccactgcgcccggccaaatttctttttcttattagatttaacattctaagaaataccaaagataaaaagtataataccaatcaattatactttttaatatcaactataccatgtttattctattttttaaaagtggtctcttttaatcaaggctttgcaatgatgttgatgggaaaagtttatggtgaattttataaatataattcagtagcttgagcctaacttttttggagtgcaagaggagtgtctaagaagatatcttctatggtatgtccatagataaaaatgtaatacctttagacagagccaactatactaccagaaaatataatctgtatgttaagtaagccatttaggagttagcattgcatttttttgttttgaaaaaacaccccagctttattggagtatgctttatataccataaactttatcaaattaaagtgtatagtttcatgaattttaataaatctatatagttatggcaacatcactacaatctagttttagaacatttcattacccctaaaagatccctagcacctgtttacagttgagcctgctcccactcccagacccagacaaccacagatcctctttctgttggttttaacttttctggaaattttatataaatggaatcatacaatatgtagtcttttttgcctgagttctttcagttaacatgctttcaaggctcattcatgttgtagcatgtgtgagtagttggttccattttattgctaagtggtgttctactatatggataggacacattttgtttgttcattcatcagttggtggacattttggtkatttttaaatttttgctattataagtaatgctgctgtggacatttgcatacaagtttttgtgtggatgtgtgtttttgttatttctcatgaggagatacatcagagtgaagtcagggttgtatagtgactccttaagtcattgccaaaatgttttccaaagtacttgtaacatgctgcatttccaccgccaccgctgcatccttttctgcttgattaaatggttaatgtttggtctgaacttaagagcaggaagcagggtatgtgggagagttgaagaagacactccaccaccaccaccaccactgcaacaagaagggcactggggagtcagattggatgacacaagccaagccatgataggactgcaggaaacccaggctygaagatcgtagcagacatacaaacyaatcagatgggttttagaaagacttagcttgggggtggggtaaaccggtggcagcagacctctgaaatggcacagtaggactccagctgtaggctcagctctagagaggaagactgaaaacagaaagagcaacagggccctcagccacttgccttgggttcatggcagggctgcagccttggggtactcccaatgtggccaaagtcacagggtcacgtatagagatgggaccaggtcaggaaggaaagagaaatgatctgggtctaggaaaccatacaggctccaggggcagccttagggcaacttgcagtgaagatgccatagaggcaagcttcttaacagaaatacatctgttgggagtggcccagcaggcctcagtatattgtatagaaagcagagactttgaaataataataataataaccaacctgtatatagttctcactttatactaagtacttttttaagtgctctctctctctctatatataaatttttwaaattctcactgcaaccccacaggatagatactgttatctcatttgattaagcaagacactaagcatcaagagatggagtgacctgcccaaggtcacgcagctattaagtaggtaaactaggattccaaccaagactggctggctccaggggccatcctcttgaccactaagctagtcacccctcaatgtaatgcttatcacctctgcctgaatggactcaaaaacttgtcatccagggcagggggtgctgagaatctcagcataggagaggcaagaccctagctgaaagtttaatacaaaaatatcacgcagacataggccacagattccagtgaatgtgtaatcataggcaaggggaaaatactgtatcttaagggaaaccttaagtgaaatattccttacattgtttttttaaaaacagccaaaaatctccctctagctctgcagttaatatttgagctatgtctaagataggtccaaaagtaatgaactagaacattgtcatacaggctttgcatgattttagctactctccattggtttgaataaaatactctcctactctccaaattagcgaaatgttatacaagctaacaatggtttaaaaaatgaagagtgtcttgagtaaaataaaataactttgttttttagggggagcattaaaataaaaagaagagtacattgaaaccaaattatcaatgctttgtaacttttctgtgactttatatgcaagataattagattttttaaaagagacatatgggtagtatcattatcattaacaatgactattttctgagaattgacagtctctctgatcgtacagaagacaaggcccagaccttcaggaacttagagttcagagaatgaagtgagatgattattattgggcctcctctgcctgcctcatttcctctttctctttggtctttatttcatggagcagcttgtgtgtgtgtgcacatgtgtgcatgttcactaagggctatgcacttatttgaccctcacagcagccccgtgagatagatatattattatcctcattttaaagaaaaggaaactgaggtttagtatttacatatgataacttatctgagatcattctgatcagaatctgtgttcttactactatgtattttgtacccctcctctctcctataacctcctcccccccccgccccccccccccaactttttgagatagggtcttgttctgttgcccaggctggagtgcagtagcacagtcacagctcactgtagccttacctcctgagctcaagcaatcctcttgcctcagccttccaagcagctgggaccacaggtacgcactaccacgcccagctaactttttacattttttgtagagatgggttcttattatgttgcccaggctggtcttgaattcctgagctcaagcagtcctcctgcctcagcctccagaagtgctgggactacaggcatgagccatcatgccctgccctattgtcttttatttttcctcctcaattggtcataatattaaaaaaaaatgcattttaggtcatttgatggatttattgcattcatgctattatttgacttcattgatctacaaatgattgtgccattctggcttgtgggcgtggggggttccctcagagggcaggtcccaggacagttaggttgttcgtggggactcctccgccatctgaggtcaggaagagaaaacaagggcagagcctgacttatgtacaatttattgcagggttctgaaactcccgcctgaggtaccggtctggctcactacctatttttgtatggctcatgacttaagaaagggatttacatttttaaatgcctgaaagaaagttagaagaaaaaaacattttatgacaggtgaaaattatctgaaattccaatttcggtgaacttaaataatgttttattgaagcatagctgtgttcatttatttacttattgtctatgatagcagtcacacttgcagagtcgaatagttgtgacagagaccaaatggcctgcaaacccaaaaatatttactgtctggggccctttacagaaaaagtttgccaatccctggtctactggagcaggttggagaagctgtgagctcgttgaggaaagtgactaagctttacaaaggaaaagagccagcaggcaacatggtgttcttgttgggtaagagttcttcagactctggctttgatcttgactccacctgtgtgaccttaactccacctgtgtgaccttgagcaagttactttgcctgtctatgctcatatttcatatttataaagtagtgataatcgtagttcctacctcataggttgttataaggattatatttatatgctaatcttgtcaacagtgctttaatataaatgtagcacacaaataagttaattaaggttcattgttgtgctatgggcgtttcctctaggcttcatacaacagggccctactggcccctaaacctcagccactctggatggcaccccacccttagaaatatgagaccttctggttggctcctgagatccttctgtctccagcacaggctctggtggctcacaggtgtacttttctccttattgttctgggccagtagctcccaatgccagccctttcagaggctcctgccctctgttccgcagcaggaggtgtgatgcggtcctggcactgcagtcacgcagggtgcctcggggtcccaaatgwgggccatgtcattctcacacgagcctccctctgtgtcatatcacaatgagtgcatccctgatggccctgtggggccacaaccatgaacattagtccagagcaggggtcgagccatgccctgcggtgaccctgtgtgacctgctgagggcctggctgctctgcatgttcatcaatatcacttttatgcagcaggtaccacatgccaggcctcgggctrgggctctgcacacatcacccttcatcctcatgagatccctgcagagcagcacaatacccatcttacagtggggaggtcaccacagcagtcagcaaagtctccctcctgtatctagggctaaatgtgttccttccccctccctgagggccagtgttctgtagagatttggtttccctcaagagaggtggaaatcatgtcctagtatgataactatgaatcctttctgcctcttacccttggctgcctcatcccctcacccttaggccacattggtttctcctaagcaccatgtgtagtaggtattcagtaaatgtttgctgtccaggggatccatgcaggaargtctgaggttacaagcaggtaaacagaaaagcccacmgcacttcacccgcatggtggtgtttggatctattataacagcacgtctaagccaggcctgttcatcccccatgggacagctgagaaaacaaaggtaggtgcagagaagtgaagtgattattccaaagttacagtcacaaacccagctctgactctgaaacagaaaagtgttctaggcagaaatgacaactgagggctaatgagcattaactggactgcaagctcgatgagggcaggggctattgcmtgtttattcactgttggaacccaagggccaagaatgctggctggctcatgggaagtacccaactaatatgggtggaagtcatagcaaatattgttgccaaggtgcrgatgaatcaggagcttcctatttggatgggaagcaaaggagagagtataactgcactgagagggataccttctatcctcaagaattaagaaacccccaattaaattagtttttgttgttgttgttgttgtctaatgagcttcagtttcttctgtatccacaacacggatcattggccttggtgacaaaaacttccttgccccagtataccttatcactacagggaaaaagtccgtgtgtacctaccgtgaagaarcaaggttgttacctgacacactaacaacacatcagatgcacttgcagaatccggcttgtctctggggaaagaaacaatctacttatgccagaaaacctctggaaatttacacatcgtatgtggtgctatggactgaattgtgtccctccaaattcatgtgttgaagccctaactctccatgtgactgtattttggagattgggtctttaaggtggtgattaaggctagatgaggtcacaaggctggggacctgatccaacaggattagtatccctataagaagagacaccagaaagctactccccactccctgccatgtgaggacasagcaagaagacagccatctgtaagccagcaagagagccctcaccaggaaccaaccctgccagaccttgaccttggacttgctagcctttggaactttgagaagataaatttctgttgtttaaggcacccagtctatggtattttgttatggccactcaagtgtactaatacatgtagtttcccaggattaatccatttatatraccaatatctggctggaragacctttaartcttcaacaacagaagcagaattcttcaaatgatgccactagtagttaatgaattctatccaaataagtagcaggtataatgatccatatttttacaatacgaaaagcagcatttaactattttctgtttacaaaagtcacaccacaaacactgtccactttaattctcagagtagtgctatgatattgtgagaggcaagaaaattcaagctcaagagaggttgaatgagttatctaaagccacatagcttctaagtggcaaagctgaattctagcctcagtgtttgacttttggacaagactgtgtagactcagggaaatagtttagattctctgacctttcatggctgtatctaccaagtggcaaaaaagagctcaaaataaggcactgtaacccaaggagaaatcaggaaaatttagaacgaaggttttgtctttgtccttaatttacctgacagcattttctgaagtaatggatgtctcaaaaatgtgtgggatgcaatatgccacatttgcagcaattgctaggcagaataaggagaattggggaaggtgttagcggcatcctgccttatcagctgtcaaggccatttgctcttgtttacctgaagcatgccacttaagaagcacttcattttccactgataaaaattagaggatttaaattttgggggcaaggattccagaatgaaaaaaaccatttggctgaagtgtgtgcatttgatctcttggaaaaaacagagatttgtgaaaacaaaaaccattacaagtcgatgcaagcctcgtacaagaagatgtatgcagaggtttcttcagttggtcaggcttatgcacacgtccctgttatacaatcactgaattactgctttgcttaattgcttccattttaaagagaaaaacaacgtaataagactaagatctaaaaggaaaaacatgcaatgcttctttctcatcaaactgggagaggaataagaaattaacatttattgcatgcttactccatgtcaggctctgtgccaggctcttgggatgggtatgttgcattttcatcttcacagcaactctgtgaggtagagagtatcatttacatttttacgaattaagaaatagagttgttaacttcttcaagctttttctctttggaacttggggattgaaacaagatcagatgactcagaaatccttgccgtcgctgctaatggaatccagttactcccttcccattctccctctatgatgattccaggaagggatgaggccctcttgaccctggggtatatgaggacaagggacctgggacagggacacttttcgtaagtgccacacttcaaggtaaaaatgcccatctttgctacttaaagagcaagttcctcttgaggttctggggtgccttcccttcttcctcattaacttatttctcccacagtgaaagcagagaaggtctcttttccatgtgacgatgacttttgtatttttgcctgcccagtgatagttccctttgcagggtccacaatcagggtgaggtgtggggaggtctcagtctctctatagctttggatgatctgaaattgtctgggagtcactttccagcctgggtcattggtggcctcaggattcactgacaagtccagaagaacaagacatgtttcctgggccgccaaggtccctcttctcagatgtgaggaggggatgcaaaaggctactccaggagacatagcatgattctgcaagtgcattttggctgaacatcatgagatgtatttttctttgtagatcaggttataaaagcacatagtatagatactggactaaataaccatctgtagtagtgtaattcagccacattataggttcttaaagacagtttcgatagctagggaggctgtttaacaatagtagctaggagcatagactttgaagtcagactgtctggctttgtatctcaaccctaccacttagctgtgtaaccttgggcaagtgttcttggacctttatgtgcttcagtctctatctgtaaaatgaaaatggtaatactgaccttacagcgttgtcaggagtattgctgctaagaagtggcaattctgaggatgatccatttgaaggtcatctgtatttttttctctggctgtttttaggattttctttgtctttggttccctgcagtttcactgtgatgtgtgtaggtgtgwctttcttcttatataagtgccacactcctaagtaaaaatgcccatctttgcygcttaaagagcaagtcctcttgaagttctggggcatgccccccttctttattaatttatttctgcttgagttaaagcagagaaggtctctttcccatgtgagaaagacttttgcattttgcctgcccaattgcttgggaattgttggttctcctgagtccatggattgatgtctctgattggctgtaaattattttcagttatgacttcttcccatgatgcttcttccccattttctcccccttctccctcttgaactccaagtaaataaatgttagactctcccactgtatccaccgcatcrctctctctcttcctttttttgtgtctgtgtcgtattccagatagttttctgatattttgtggtttaattctctgttcagttgtatcttagcagctgttaaattcttccactgatttattaattttgattattacttttttcagttctagaattttaatttgtttctttttcaaatctgccaaatcctcttctcatagtttccaatttctttctaaaatttaagcctttgtttttaatgcctttgagtgctatacatatggttgtattacagtctgtagctggtaatttcagtattcgaaggcagcctctatttctgttgtttctactggctctcgcctgtgtggttacatgtgctcatgaatctggttatccttcacagctttggcttctgctgagtgtggggtgttgtctggtgactgacttattctgagtgcaaggcttgaggtgtcctagatgactcgttgctgcaaggcaggctgacagtccaccccagagctggttcacttgggattcaccctttcccagagttgtagcctttggggcacagatgaatctgggtggttcactacattctccacttttggtgtccctggcttttcctttagcctccttttacccttgaatctgttaaaataagaagctcagttttacaactttttctaccaaattagcaaatactcatgggtactcaatttacccaagtaggttctcagtttctagaatttggtcttccagtgcttactacattgataactctttgaggccttttaagaggatgttttaaactattcagtgttttgagttgtccttattgggcacgttggtcctaatttcttagtgtgccattactagaagtggaagttccccattctgactttgatacaagaagattggttgccctattatgtctgttgctgtttgtttgaggaagatacttttgtgacacctttttctgcccrtttccctttttgatactcctttttcctatataagaactatatttatttgatttggaaaggggtaaatataatcatcttatcattcctcctggcagaggtagccgttgaggagtaaggcttttttgatgagtagaacactggtgatttgacagaaaagaataatacttctggccaatattttccattaatttttctgttaccatcttaaaagcatcagagtttaaggagataattttctatttcgacccttccattgaggtcactttttttacgaagtctaatctctgcaattatgacatcacattttattgtagagcaaagcatygtactttcagagggcaaatatcatttaagtgatagaactgatttttcccccaaaataaacacagctcaagaaaaagcagcaagaaaattaattggtatactaggagcaggaactgatctcctggtttgctaggtaaacatctgtttttagggtaatatcaggtgttcctctgagggaaatttgtactttaatacatgaatatattggttcaaagtaattatgaagaaaacagtgttccatgtgtgttgcgatcttattgtaaatgagtataaattttaaagggtaaaggatcgtagtwatcaagtcacacttgaaaattcttcacctggagacacctaatgattaatgtaaatgaggttggagaggaaagactatgagaggtgctatttgctgctgttgtattttccttagcagttttcccctttcacatctttggattccaaattcctgtctccaaagcatcaagctttctaatgattggcaaaaaccactcaaaatattaacatttgtattctgcttcttagaagaaacctttgaaatatgagagaaaaagaaattgaagatgactgcgcctatagatttattttattcatttgaaattttaccagcataaagtcaacttatagtgaacataattctctttcaaaaagtcttcatttgacgttaccctccaaagattgcttagattaatgggacgaaagttttgggtaaaagcttgggatacctgaaatttgcagctgtatacccctggctcttgaygtgagacttgacattgaaccttacaaagagggcaaccttaggtgatatcattggtcacaaatgcattacagaaaatgttttctcttagttaaattgatatatctagctcctaagttgattgattcaatayaattgaagactgaactataatggattttgagtattctatattttatttagtatttatatatataaatatgtaactatattttattgagtatttatagttattactgatatgaagtatgctttcacattcttttcattaatatggcctaaaagattactaaaaagtaatgcattgggactttgtgtggaactaataagtagataatctctatgattgtatccttgcttgaaaaattttacgatgttctgttcagatctatttgttatccattgtggatcacagatacaaaaagaatctggttgctaagcaactagattatatatgatggaactccttgaaagaacttaagtgttaactctttagaaattgagaggtgtctgagacatcgtgaatcccttacttttaaaagtagatatgcattatgctcggaaaagaactacagtgaaaaactgcctcaaaagtagacaaaaatgatctcagaactatttgaataactgctttccaatttagaaaattcagtcattaaaaaaaaattgaaataattgcactgaaaatgataggttagtgctttcttttaagattcccatctctaatgggtttattagccacctcttttctctagtcattgtgtcgttaccaarctcccaaaaccaagtatgtaatgacgcacttagtttccttctgcctttctcacaaaggggctgatctttcaggctttgtttgttttgtctttttttttcatttttttcctatcaagtttcgattttgtgaaatacagttgaacaatggttggaacattaacttgaaatgaaaagaatcataattggagttaattttttaaatcagtttatcagttctccaacaataactgatttcttttgtgcctgctgttttctgttcttcttgaaatgtcttatgttttcctggatggaccagtaatagcagatgcttctgtataggtagaggtgagagctcactatatttcttcatttgtgtatgctctctgtagccttaggggagtacggttgttttaaataaatggaaccttttggggagacagggagggtggatgtgtcttctgattttatgagtctcttttgtttctagagaatctttcrtttctgttgcttgctttttcttttcctcctttcaccatcaagcatccaggggaggtgaccctccaagttacctccctccctccgaagtggtgccctcccaagactttggtcctggcaacttttcagccccttctttcatttcctctgtagccaaggatcagacttgttctcagtatttccacacttagggtggtacactctttytgggggtgattttcatctgttccccaaccaggctctgctgcctgactctcttttctggaaaggtttctgctgctttcagacgttcatttttctccctatgcattaattgaagtttagagtatrtttcgtgtcctggctatgctacaggcagggctggcttcataggcatgccaccaacgcggctgcacagggccctattctcagaagggcctctcacctggggtttaatgcttggcagtcactgtcttaaaatccttaataatttagtatttgaatttgtgttttgtaagtgaagtctgatgggacaatggagcatgtgccaggaccttgaagccttggctcacacatgagcctgcctccccttccccagcaacacttactcctcacctccccagccccgaactcccctggctgaattctcagccacctgcctccgtgtctgccttgcagccactgaggtcctctggctgaggcagcaacctggctgcattgcaggcggaggtcagtgctctgtcctagccttccacacccaccagggacctggaggcatgtgtgggaaggttgaggttcctggttgacagtgtcatggtacattcagccagcaactcagtggggcctctcgtctactacagatccaggtacggggtgtgtcctggcacagaggtttcgattccttggaagctgccagttcactgtggtttgggtggactctgggaaggggaaattgatttctctgccctgggctggagccctcattttcatcttggagtaagccctgccaactgtgtagtgtgccctggctgtagaagtgagttttgggtggttttatttgctctcgtggttgatttatatggttttggagagattcgaatttaggcagttgtcattatctcatgggaaactggaagttccttatttcttttaatttgcttttatcaaacttttttccaaactgtaaaagcaatttgtatttttttgcaacaaaacaaacaatatgcgggtatacaaagaaaaagtcaacattctatttccactccctctcaaagtgaccagtgtttacattgggtacgtatatgaggtcttcccacacttttattcacaatcatatcatacacacacgcatgctcacacacatttatatgtgcaaatctacatatacacaagccatgtgggggatttgagggtgtggtaaaaatgcttatatcttgataacctgaaagtccctctacttcagtgcatctgaatccarctcattctttttaagaaaacataatattctatatccatagatttgccattattcagtcacgcatcttgtaatgawgaacatttaggttgtttccagttttttagtgctatgatcatgccactgtgctacagcctaggtgacagagggagaccttggctctaaaaaaatgaggaagagaaactaaataaataacttctatggtgtgtcctgggctctgtacagatttattctattctgtaccttatttctgtattcagacatcaacatcactggtgtttagaatgataataatgaggtactgcaaagttatttataatatactaaacttgtaaggcatgaagagccaactattacattttaggaaaaaatctcaaaccaaaaaagagttgaagcatatagattttctgaataatcttcatttgactaaaaatttactttaccagaatgctttttcttgattattttgtttaactggtattttgcttagctctgttattcaatttatttaagaataatttattaaatccctactaggttccaggcatttttccaggtgctagggtaatagcagtgaattgaatggtagtgawcgtacatagaatatgatgtcaatcacaaraaagtagatatatctaataaactaacatagaagataagatatattagacatttcagaaatacttagtacatccaaaagaaaacagaaaaaggggaatggggggaactaagaacagagaagagaagtacaaaacaaaaagcaagatgatagatttaaacccaaccacatcaatagttgtattaaatgtaagtagtcyaagtatctgaattaaaaggcagagattatcagatrggataaaagaaaagtcaagagccaactatatgctgtcaacaagacatccacttttaatataaagacacagaaagcttaaaagtatagaaaaggatgcaccagcctagtactaaccaaaagaaaacagaagtggctattttcattaatattaaacaaaatgaattttagaactaagaatattaccagtgataagtattatcattttataatttaaaaagaggccagtgagtcaagaggacataataatactaaaatattatgcatctaataatagggcttcaaaatatgtaaacactgatagaactggaaggagaaataaataaataaaccaacatttatagccagagttctcaacacccttttcttttttaaaaaatttaatttaatttaattttaagttctgggatacgtgtgcaggatatgcaggtttgttacatatgtaaacatgtgccatggtggtttgctgcacctatcaacccatcccctagttattaagcccggcatgcattagctatttatcctgatgctctccctcccccatccccaaccctgacaggccccagtgtgtattgttcccctccctgtgtccatgtgctctcactgttcggctacatgcaacactcttttcttaatagcaatttggggaaaaatattcagggcaaaagaaaagtgcaaggatcctgaggtcagaaagagcttgagtgtttagaggaacccagagcagccgggtgcagtggctcacacctgtaatcccagcactttgggaggctgaggccggcagatcacctgaggtcaggagttcaagaccagcctggccaacatggtgacaccccgtctccactaaaagtacaaaaattagctgggcatggtggcaggtacctgtaatcccagctactcaggaggctgaggcaggagaattgcttgaactggggaggcggaggttgtagtgagccgagattgcatcactgcacatcagcctgggtgacaaaagcgagactccatctcaaaaaaaaaaaaaaaaaaaaaggaacccagagcagaccagtgtgtttagagcagagtgaactgatggagcatggtccattgtagaccagggagataggcaggggcaggggctagattgcataagaccttgtgaaccattgtaaggagtttgcaaaagcactaaacatgtttgcttcatactgtggctttgatttaatatttaatcattagctgtatcttagaatttctccacagcctaaaactgaaaacagtaggtgacaaagaaccccacactttaaaaaacaggctggacctgataggataccatcaggaaacagatatgtattcctcccatcccttctttcaaacctgttctgtcagatctgcatctctgaattgtatctcagggatctatcacagcttttgagtcttattttcagttattaaaaagttcagtctgatcttaatcaaaactcccatctcccattattcagttcagtgctcttacgcttccttcagctcagcactgcccttgtcttggaaattgcaacagggaagagctagctgtgtggtctttgtctcagctccctggcttttcctcctcctgtacagactgttggttcctcagggtctgggcaggggcagtgagaggcaaaaagggagaaattggttttctgagggtcttctaactctctctctttaggtactgaataacttctctcatggaatactttggtggttatttttctgttccctgcctccaacacacacacacacacagacacacacacacacacacacccccgccccccccccccccacacacacgaatgtttctgccccttgacaggggactgtgctctccagctgacctgtttgcataccctcctctcctggttcctgctttttgggtacagctccagcctcttcctgctaaaatcccctcactccggtggcagtcagccctcctgggtagggtcccttccaggtagttcaagtctgctcctgtcttctaaagacattgtccacttggcccatagaacaggttacaaacctttgccccacaagagattggaatgtaagcttctctcgctatcttcttgccctctcccttcaagggcagctccaggcagctcccatctctgtggtacmtgccccaactctcctaaaaacccttctgcaccttctctggtggcaacttgtggaggcctaggagtttctttccacaacccagcaagagttctgcctgggaggccagcctctcctccagcaagcacattgctcccttgggtaagttcccttgctactgccctcacttggaaggggaatttcctccccacttctctactctaagaaggagggggaactctgcagcaatccctactaagccaacaactctttcaaaagtccccttcacccagcaagtccccagctttctcttaaagacactgaagatgggaggtgagctcagggtggtgggggtatgtttcccacatcctggcaagttctttctagatgagtctctatagtgtgggatctttatttcagctttcagccatttaatatcctgtttcctgtggaaaaaagtttgactatagaaataaagctatcagccgggcgtgttggctcacctctgtaatcccagcagtttgggaggccgaggtgggtggatcatctgargtcaggagatcgagaccagcctggccaacatggtgaaaccccatctctactaaaaatacaaaaagattaggtggccatggtggcccatgcctataatcccagctacttgggaggctgaggcaggagaatcgcttgaactcgggagttgcagtgagcaaacatcacgccattgtgctccagcctgggcaacaagagcaaaactccatcacaaaaaaaaaaaaaaaagaaaaaaaagaaaaaaaaaagaaagaaagctatcacacttaattgtactgatgaaataaaaaacaccagctaatttggtcattcaggattcttttgaaaagctctcatatggcagtagaaatttaagactgcaccattaaacatatttttcagaaatcagttcatcagtttaccatttggttgggaaaggaggaggccttttcctgtaaggagcattttaaaagtgacatttaaaaattagctaccacgtatgcaaatacttctgaaaacttttatgtcaaatttaatgatttgatcaattaggaaatagcaaatatayccatagacatcagttgcatagacttgaatttcacaattaaaaagtgagtatatccttgggtattttactgataattttcactgtggctcattttttttttttttttttttttggagacagagtctcactctgttgcccaggctggagtgcaatggtgcaatctcagctcattgcaacctctgcctcccgggttcagtcaattctcacgcctcagccacctgagtagctgggattgcaggcatgtaccaccacacccagctaatttttgtatttttattaatagtagagatggagtttcaccatgttggccaggctggtcttgaactcctagcctcaagtgatccacctgtctcagccacycaaagtgctaggattaccacacctggccactgtggctcacttcttaattgttgggccattttccccaagtaccctgtttctttatcagaaaagtgatgaaaatatagaattatgatgactgttctaataccggctgaagatggaagaacaaattgggaacgattgatcaagaccacacttcagatctgtgagactgtgcataaagtctgcctgaaagctggttgcattctgttgcttttaaatgtctggaaataaaaatggtctggtatctttaaaaagtttagaaaaagtccagtggcttagaaaaatgccagaagccattctgtcagaattctctagaggaggtagtaaaaccagcctgcagttttttattaaaggaactcaccatawgatatatacagatgtgatggtgaggaatgtcacctccacagagacaggagaagacagtcacaaggagcagctctaatcccttaggatctgcatgaagcccagggtttttgagaggtggaagttaaagggttaagtatttctgtttaatgtagaccaaggttaaccaagatgaaattaaacattgcttgacagcagttgaagattggcaagactatggcaactacacttctctacattttactctcaattatgccattttgtttctaattaatcactagcattttaacaaaatgatgtaattgatagctagcaaccagactgtcagtcttctccccacatcagaaggtatctatccatctattcagctattgccagacacaccttgtgcctcatggcagctacctagattgccggccagagggcctgctctccacactagacctgtgaagtactagaaggttcctaagaggattccagtaatgacccttctaaggctgtcagtggaaggaggattgtcctgatgtgcttctaaatcccaatggttgccgggccttactcctgacttttagaaggctaccccagctgtgcctgcagcagcaaagggattttccatgtgtggattcagagaagtgccttgcgttcacagggaaactgtttttattcttgtgtaacatttgaggccatccctctgtaggttgctgacagcctcctgttttccatttttcctctctgcagctttctccagggtaaaataaattgggcttcaatttttgtacataatttttttaatgaggatactaagacttaaaaatagtagcaggaaacataagcctttattcactttacaaagcataaatagtaacagtatacttcatatgtacagtgtgaccagttaaaatggaaagatcctgcrtatgggaacaggggtggcactagtgagtgtgcctggtaaaaaaaaaacagggcaaaaaggcagaaaatggagagaagcaggggacagactgaatgattagctcacagagaaaaaggaagagagaagagcctctttatgcttcttctgacatgtcctctagtactaaagtggtcatgggttagctttatccacagtctccctgtgtggctatcaagcataatcagtattgtttttcaagaatagaaccaagaaaggaaaacaaatgtccctctcgctttgtacccctactgaaatattgaagaactaatttgctggagacaaaatgctggtgtagaaagtgacaggcctgattacatactgctgtcacaaaaattgatttccatactttatagttgtaccttattatcaggtgcatatattgcatgtctgcatttaacatttgtgcacaaaataaacttctttgattgcatttgacttggcaccttgattatctttcttgttgcataccggaattggttgtgcctctgattttctacttctgtctttagtgcacttgtaatatgccagtgtctggaaaccattatgacaggtcctaccaaggatgccagctggacttgaaggagacacttgttttctctcctaaagtctattctgtgaaccacatgacctgaagatctgctttgtttaggactgggagcctgctctttccacttaagcactctcaactggtttcacaaggctgagtacgcatcagattttcacttcacttgacctgtgacataatatcctcaactgaggactccttccttttttctgatgtaatagtaatttttaaaatgctttcctggaaactgattgaaatgggcatkgttgccacttcatagaaatacactgaatgttgactctaaggcttacatatgctttggagacagtgttataaggtttcaccaaaatagaaggaagatggaaaaagaaaaatgatcagtggatcatacagaggccaccaaggagagtatttgagagatcagggcaactagaataacagagatgacagtttagggcagaatacatttttgtaagagaataggaaatgttttgtctttaatgaattaagatcaatgcgaacttttattccaatgctgatcttgcagcaggttaaataacatatcctgatgttgcagggcactttctcagaatgcagttaagtaaataaagccttgtttcttggatcatatcgaagtaaataaatgtttttattctttagtactaagagctttatgttgaataccatgtttctgatatgccgttatagaatctgataagtactttttcacagagaatgaagttgatttttctctactgaaaaatgaaattacaggaacccatcctcctgtttccttcccctacccatcaaaataggaggatttgaaaacatggtaattatctcatgtgatttggtttattaaggttaaagacgtcttatcaggttattgctaaaggtttccaagaccccttgcccaactgatgtcggaggacctggtatttggtgctatgtggagtaactatacagctaatttcctaatggaggttattgttattaattcaatttatttttatagcaastttattgagaaataatttaccaccatacagttcacccctttaaagcatacaacttttagtatactcttagaagttgtgcaaccatcaccataatcaattttagaacattcttaccattcccaagagaaagcctctacattagcagtcactacccattttctctcattagcagccccagccccagaaaaacacaaacctactttctatctctataatttgcctattctggacatttcatatgaaatgaactcatgcagtacgtgcgtcttttgtgtctggcttctttcatttagcgtagtgttttaaaggttcatccatgttgtagcaggtatcagtaattcatccttcttatttctgaattattttccatttaatggacatacctcattttatttatccacatttgggatattttcaagtttcaactattatgaataatgttaatatgaacaatcatgtacaacttatgtggacagatgttttcatttctttcaggtatgtacctaggggtgaaattgctgggtcatatggtaactctgtgtttagctgtttgaggaactgcctgttttgcaaaacagttgtaccattttatattcccatcaacaatatatgagagttccagtatcttcacatttttgccaacacttgttattatctgccttttttataatagtggggacaattttcagaatgaaagtgagcccttattaattatcccaggcatggcatgaaccagtaatcaaatatcctgagctagtcaggatatttgattcttctagaacttttgggaatgaggcctactcagtagcaaaaagtagggggtgatttgggggcagtggagctaagtgccagtaagtagtggttgttggatatagtcaacaaagaggacatatccaattttattataatatcctgtgggtagatattactgtttcaaaggatcaagcacatatttatctggaaaggaatcaagtctttaaaatcatttttacaggagcaattatgttattattcttaatagtaagatgcaataggagatcagctttgttcaataggtaaaataactacccaggtgaaccatagccattttgtccaaaattgattcccagaggcaaatttgtagcaggtaatttaactactcttactttattcccagggacattctttttacattgaagtgcatctctttcctaggcctcaactgagctgcttgtgcagggtactagatgttcaggttttacaaatatttgccatcttattctgtctttttacactgttattgacacactgatggtgtccttgtaagatgttttgagtgggagtctctagccctccaccctagcactgtggcaggtaactcatctggctagcagtagctcatggtactcttatgggatggttggggcgatgctatactgtaaatatcagctaacccagaaaccaagacatcacagacaatcagtggtggtgttggcacaataaatacctgctggactttaatactcataaaatgtatcctttctagatctggtgtgttggcttttctttattgatggaaattatacatcaaaatgtttccctttcttatttgctgtcagaaagcttagagctgattttttattgttcagccacaatcgctagttcatcagtgtctttagtataacaatttctgtgctctttccaatgtttgtttaaattgttttttttaactgtcctaatcttatgagttttctttaacattgttagccacctttgaattatttttaaaggttggagtataaataatttttaaaactcccatccataaaagataactatcttttctctccagaactataagtctcttggaaatttgatttgatttaggtaattggccctactacatagtaccttccctctctgggctcttgaccatctggggttatcctatgtttgtcatgctagggaagcgtaagaatgttctttgggtattctttcagaattaaataagaaaaggcaaaatgtttgataaacagacatttatttcaatattaaatatccttcatataaaatgggctgaagtctaaattgcacgttcttcaagttgtccttgatcaagatgtgtagatgcagaatagttccttcatttccacatcttttctagtgagcaggtgagagtactttctctgaaactgaagagagaagtgtcctgatcctaaaacctttcagagagctgcctgactgcgctgctcaggaaaaaasgggtgctcaccctagcatgatagggatggccaagtgccttggggcacccagctgttcagcggcattgtggtgaaagggaagtacagtcgatcctcattttttgcacattctgtatttgagaatttacctacttgctaatgtttgtttatgtctaatcccaacatcaatacttgcaggacttttgtggtcatttgtggatatgtgaaagtggtaaaaaaaatttgaatcctcctatgtgaatgttcccagctgagatcgaacaaggggatgttctgccttcctattttagctctaatactataaatgtgtccttttctcacacatggctcagaaatgtgccaagtttttcacattttttgtgctcttcattggtgatttcatggcttaaaatggccccccarccatagtgctgaagcgctgtctattcctaggggaaagaaggctgtgatgtgccttttgaagaaagcacatgtgttagacgagcttcattcaggcatgagtcatggtgctgttgtccatgagtcccatggtggttaatcagcactatatatatttaatgtggcatctttaaacagaaaccaacatagagcacagttaagtattgatcagttgaagagaatacctcctgtgaccagaggctcacaggaatctaaccctgtatttctcctaggagcaatgattcaatatttatgaattcagtgtttggggtgacttgataaaacataactaccttgcataaagagaatcaactgtatgtctttttctgctcttataattcttcatgttggtgggcccctgccttcagccccaaagaatgcagcatggggcttattatttcttgaatctgtttttttttttctggagaatttcattcaacaaattatgaatattattaggtgttgaactgagcttttgaaaacttgtcagattcatcttcaagatttttgttccaaacatccaaatttatatactcattgtgagtttttggatgttaacaatagaatttgattcattctatatcctttgagcccacatgatgcatttccctgtgttaaggcttatttgttgctcagttgagtgactcattcaccacttcttacttcctggaggtttagtaccactcttaaaaatagcaagaggccaggcatggtggctcacgcctgtaatcccagcactttgggaggccaaggtgggtggatcaagaggtcaggagatcaagaccatcctggctaaggcggggaaaccccatctctactaaaaataaaaaaaaattagccatgtatggtggcgggcacctgtaataccagctactaaggaggctgaggcaggagaattgcttgaacctgggaggcggaggtcgcagtaagccaagatggtgccactgcactccagcctgggtgacagagcgagactccatctcaaaaaaaaaaaaaaaagggtggaaaacattgcattgcacaatgggttgaagtgagaggtctgccttattttggggtttgtagctccctccctgtgctggaagggggctgttgtgagtgccccacccttgcagatgtcagcaggaaccagtttctcttccagagctgaagctccagcgtgctgcctggcttgaagctgctgccctctgtcccaactctcaccagctctcttgggttgttccctgctcttgatcctaatcagtgcgtgtttctcacaagcctcttcagtcatcatgttgacccaatccccagacaatgggtagtaattaagtcaactttcataaggttatggtatgcgaagtgattacaagagattgcttacaagagcagttagaataaagagttcaggtgagggcagtgtctttagtgagccaataagttgtctataagttgattgggaaattgtttagtctgagattacaataagatgttttctgaagcacataccaatgaacagattccttgaagagatttccttacagaacagtttgcattttcatgttgaaaattagcttagtgattatcttcatttaacaggttaaaaaaaaaaaagaaaaccaaacctgatgaaagggtgacttggtatcaggaatggggaggtgatttggtgaagggatagtgactaccactgaccactaaaatagcttcatttgtttttgtattctcagtgtctcatttcctcccatgttcctcttttttattttatcattattttgttttaaatttttaatttttgtgggtatatggtaggtatatatatatttatggagtacatgagatattttgatacaggcgtacaatgcataataatcacatcggggtaaatgggggtatccatcacttcctttatgtcacaaacaacccaattatgttcttttagttatttttaaatgtaaatacactgttgttgactataatcaccctgttgtgctatcaaatactggagcttattcattttattttactatatttttgtactaattaaccatccccagttcctgccccacccccccactactcttccaagcttctgataaccatcatcctactctctgtctctatgaattcaattgatttaatttttagctcccacaaataagtgagaacatgtgatgtttgtctttcagtgcttggcttatttcacttaacataatgacttccagttccatccatgttgttgcaaatgacaggctctcattcctttttacagatgaatagtacttcattatgtacttcagtagtattcctaactatccatcaacagatgattggataaagaaaatgtggtaactctcttctaactatctcctaactatccatcaacagatgattggataaagaaatgtggtaacattttctttatccaatcatctgttgatggatagttaggtcatttccaaatcttagctcttgtgaatagtgctataataaacatggcagtgcagctatcttttcaatatactgatttcctttcttttgggtatatacccagcagtgggattgctggatcatatggtagctctatttttagttttttgagaaacctccaaactgtccttcatagtggttgtactgtaataatttacattcccaccaacagtgtacgagggttccctttccgccacatcctcgccagcatttgttgttgcctgtcttttggattaaagccattttaactggggtgagatgatatctcattgtagttttcatttgcatttctctggtgatcaatgatgttgagcatctttttatatacctgtttgccatttgtatttcttttttgagaactgtctattcaggtcttttgcccattttaaatgggattattagatttttcctatagagttgtttgagctccttatatattttggttattacgctcttgtcagatggttagtttgcaaatattttctcccattccgtgggttgtctcttcactttgttgattgtttcctttgctgtgcagaagctttttaacttgatatgatcccatttatccattcttgctttgttgcctgtgcttgtggggtattactcaagaaatctttgcccagtccaatgttctggagagtttccccagtgttttcttttaacggtttcatagtttgaggtcttagatttaagcctttaatccattttgatttgatttttgtatatggtgagagatagggttctagttccattcttctgtatatggatatccagttttcctagcacccattaaagagattgtcctttcttcaatatatattcttggcacctttgttgaaaatgagtttactgtagatgtatggatttatttttgggttctctattctgttccattgctctatgtgtccgtttttatgccagtaccatgctgttttggttactatagctctggagtatgatctgaagtcaggtaatgggattcctccagttttgttctttttgttcaggataactttggctattctgggtcttttgtgattccacttaaattttaggatttttttctctatttctgtgaagaatgttgttggtattttgctagggattgcattgaatctgtagattgctttgggtagtatggacgtcttaacagtattaattcttataatccatggacatggaatatcttttcaattcttagtatcctcttcaatttctttcatcagtgttttacagttttaattgtagagatctttcacttattttgttaattcctatgtattttatttgtagctattttaaatgggattactttttgatttttacactgtccactgtttgcatacagaaatgctactgatttttgtacgttgattttgtatcctgtaactttactgaatatgtttatccattctaatagttttttggtgaaatctttaggtttttccaagtataagaccatatcatctgcaaacaagaataatttgactacttccttttcaatttggatgccttttatttctttctcttgtctggttgctctagctggtaattccccatattccctcttaccgttcacttctgcctctgctttgtgcccttagcactggagctacatcttaagaggtggggtgacatgttgatggtatttggctgagggaccctgaagcttctggatcttgcttgtaattgtccactctgttcaacaagatacctagggggcatgtgtgcacagaagatagtgatttttccgggctcttgttattaaaccttggccccacactcttaatatggaacactgctttggcagaaggaagagctaaccagagataccacttccttctgggaagaagcagcagggctgggagaatcctagcccagactttctctggaagctgctccagctcctgascaggcttatcttaccagccgggtgggagttaggaggactccggagtcacacagaaagccaaaaatctcctgaaaacaataccctttccagtgtagatcctaggctcacccctcattgttcactcaggaattaaggcagctctgggggtaaccccatttatggaatccatgcaatgatggcattgtgggggacactggctaagctcccaaggggatgtgctataactgcatcgcagtggctaggccccacccttctcatgcctcttcccaggtcactatggtgatgagtcactaatatcaagaagtaaagaagaatggcagtttataaaagaccataagatctccctattccaggatcaatggtacatatggttccttttctttcttctttgtcttacttgtcctttaaaacctccatttgagagctgcctcttccagaaagccttccttgaccacctccagctgaagtctggtttggagctatcttctctgagctactacttgccaccctggaaggctgtggctggtacgtgatcttgagaaagtagttccctagctttgtgggagtggaatctagatgacaaatggttaaggagttggggataggggtgtagatgggacagccaaggctgatacctttcaaatttcaggttgaactgtggaatgaagaaggtagtgactgaaggtcactggggaagtttatttatttgttttttgatgtgaagaacttttttttaaggcagagaagaggagtattggaaacattagtaaaatagggaataatcaacaggtcatggcccaggaggaggccagaagaagtggaatcaataacagatggaaggaagtgaaagggaagacacagagggagctctggctggacatccccaaagttgttcaacaatgggagccactgtttcttgaaagttgactagatgctggatagtccttatacattctcatctgatttccacagcagccacttcacattctacggatgagaaaaccgaggcttataacaggttcttcaggtggtacatgttggggagggatgtgaatgtagtcagtgcaacttgcagaatctgctctaccagagtcttacttctcaaagtgtggtcctcggaacagtaccacctgggagcccattagaaatgtcaactctcagccacatcctcagaccaactgaaacagacctgcgatgtttacatatgtttaggtctggaaaccctggtctaaacttctgccccttgttctccttgaagtgttagatgttggcttggctccctgcttagggtaaggttattggagcatgccgagggcagaggcttgagggtagaggggaacagcaaatcatgggaatgtgatggaatgtattaagagagagcttctagaaggttatgatatctattagttcacaggttatggctaaactggtaatgacttcatttaagttgatatcattgtactttgcagagagaacagccaagtaaccttggttgactctggttgttctaatattcttagctatccattctcttgggagggtcaaaccacagctggctgatctgttatcaaaggatttgtggtgcctcgaacatgtcctgttatttcacaatcagtgccctttgtamatatggttccttttatttcttctttgtctgacttgtcctttaaaacctccatttgagagctgcctcttccagaaagccttccttgaccacctccagctgcagtctggtttggagctatcttctctgagctactgcttgccaccctggaaggctgtggctggtatgtgatctttaaaggacttagcatggtacctggcacatagtaagtgctcaataagcactagcttctattattagcccagaagtaggaataaaaacagttaagagtagaacacatggttcagagggcagcatagtataaagggggcaaaaataaccgaaggtcctagcaagagccatatggaagtggtcaactaggaggtttctgtgctgggaagggagggtgagaaggcaagagagaggcagtagaaagttcattattttttaatgtatttttattgtgtatatttaaggagagaaagtgatgttttgatatacctatgcatagaatgattttgaatgggcctaattgctacgacgtcagttacaagacggaggagaaagaagacaagacatgaatttaaagaaacttgcttatccaaatcattcttcttttaagaaagctttrtattcattatagctgattataagagttaggacaaatttatgatgtggcagacttgtgttttagcttattagtgtgtctctgtgctgcactgaagcccttgtcatcactgcagtgtacgtagctcccatttatgtactttctatagaatctgaagcctaattttaacattgtatcgttttttatagttattgacactttgcttctatcctatcaattctatctgtaatttatttcaaatcaatttcttgaacaggcaggtaatagcytattatattatttttcctatgggaaaatatgatcgtttattaatttggttttttaaaatttactaaacatctattacccagaaagcactatagaaaatgcttttgagagatgcagttwtgaactagcaatcgcccttgtccttcaggaagctgacaggctaggaggggagatatgataggtagagatgactttaaacacaacaatgtgagatgctgtaagagaggcagggtagtacacttactgaggaagaataacttgcttttgcctggggacaggagtacaggataaaagctttgaggcaaaggcagtggttcaacttgaccttgagattttgtctgggtttgacaggaagaaatagggcaaaagccatttgaggtggacaaaatagtatataaaaaataaagtttgatttttattaacacaatggtgaaaagagagaacttcmaggtagttccatctgttttttttttatttattttttattttttatttttttttgagatggagtttcattcttgttgcccaggctggagtgcaatggcatgatctttgctcactgcaacctccgcctcttgagttcaagcaattctcctgcctcagcctcccgagtagctaggattacagacatgcgccactatgccyggctaattttgtatttttagtagagacaaagtttctccatgttggtcaggctggtctcgaactcccgacctcaggtgatctgcctgcctcggcctcccaacgtgatgggattacaggygtgaaccatcttgcccagctagttctatctttagactaaaatttaagtatctataaaaaggaggaactgctgtttaatgaatgcaaatgtttaggtacatatatattatctcaattaatcctcaaaaaatccctatgaggtagggaggtattattatttgcattatagaggtaaataagctgaggttcaggaagttaatcattttgctcaaggccacacaggtcatctgcggcagggctggaaatccaacacagatctatctgattccaaagctttccactgcttcctgctgccttcctgcggacccattcataagactgacatattcattcattccactgacatattcattcattccacaagtagttattgagcatctgacatgtcccrggtgctatgctagctcctggacatgcagtgatggccaacctggcctagctacatgtgggggacaaatggaggcacaaatagtaccttggtattctgagacctacagatttccaattaagtataaatttagaagattaatgtgctttattgatctcatcaaatagcctattgataaccctcctcaaataactagtaaaggcacagtgttcactgaggaaaaacagatgggaaaatacaggatatttcaatgtcatagttggaaaatttacaacttaactattttattaaaatgtcagtactttggaattttagcagttgtagacctgagagcccgagaggagactgcacccatgccatgcaaattgtcataaaagttttagataaaagttcatatatacgtttcagagagagaaaaagagaaagagaaagagattttgttgacagccagatgaaattaagtggtcagaaatttaatccactggcccactaaaagaaatattttcaagatactgagaaatgcaaaaaaaatgtaaaaaccaagcataatatcaccactttacaccacatagtatcacamacacacactagttgagtacagtggtgcccacctgtagtcccagctacttgggaggctgaagcagraggatcacctgagttcaggatttgtgaccagcctggacaaaatagtgagaccccatctttttttaaaaaagaaaaaatatatatactgtatatgtaaagtccttccccttgatcactactcctccagccccaccctagaggtaaccactgttaacaatgtggagtttaccctttctgaatttgttactcatagtgacaaatctgtttaggtttgcccatacaatctttcttttctttccttcccaaaaagaggaccacttaaaaaattcttatttttctgccattatccctttggtctcattaattaatttatttttgtcttttaagagaacagttttaaattgcttcttgtgagggtgcaacacaccagtaggattatcagcaaagtgtagacaaggctatgaatgtggatctgatgcttgggagaagagaattatcttgtgactcaactaaaatacaaccaaagactcaagaagttatggatttgctcttaattgctttaattgctgcacaattctccttagttactctgtgaacttgtaagaatccacccacagtaaaagtcgaatttgacaagttgtgagaaattgttatgaggattacagttctttgtgtcccacgtgcaaagtgcttccaagatatttctttaaatgttgaatttcatttaaatatctcaaatgaagaaaaagatatctaaccgcatgaggttggaaagcttaaaagtaattgttatcctatcctacagacacaccaaagggtacttaaagatgatatgaagtgggatataaatatctatactgttgtgctctgaactaaagcaagtagtatatatttgttatcctttatactgaattaattatgtaaaaaataaagttcaaaatatgagtgtagttcctgtgtgacgaattgcctgaattactcaagtgattgtctcaaacctctatgtcatttgtttgtagagttctttagaagaacttagtacaattatctgaaagtgtctctaaggtatgacayttctgtgtgcattattgtactcagcatttaaaacatggcattgcactgatgtccttcctgtttcttaaaataagccaagtcttttctggcctcagggcctttgcgcctgctgttccctctgctgggttgctgacgctcttctctgtatgaggaggcagaatcactcctcatccttcagggcttggctcagctcaaaggcctctacctcagagaccctcccaggatcacctcatccagagtgtcttctccctccaatcacttcctattatctgatttattttcttcatgccacttgtcataatctgtcattctcatgtttgtttgcttactttttgagttaggcctctgccttggcacccagtggagtcttcaataaatacctggtgaatgaataaagagctttattagttattcttttcctcattcgttcatgccttcatttatctgttcagcatcagacacaatattgagtgtctaatgtgtctaactcacagtgctggactcagtagtagtgattgcagtggaattttcaggtaattaatgcttagcccttcagataccaacatttacttaaaagtaaatattggctataaataagtaaaggataaaattgtaaaatactggatgagagtattccttaaatacattacagcacatctcagatagaagctctagtattgatatggtgtggtcctcackgtgaagtgtccttacagtgaatttttaaaatttacattttggtttttctgtgagcccagagggatgccacttcctttaccgtaactctgactagttgctccaacaatggccccttcctgcctctagacacaggggtgctggtcactgatctcctgggtcaaaagcaggataagacagttgctttcacggtggttgttctcaccatgaaccttgacattccagttttcccacagcatgtgaaggccttaagttgttcagatataaccttgattctccaaggggtgstgtggtagaacgcrgaaggagatttttggaaaattgcatctatagagttaaatactatgaatgtttcttatcttgtcataaaatcacctgcatacattctttttataaagccatctttgtaagatgagatttatattaatgtaatatgttagtgctcagatggcctttagcaaaggattttaggaaacacctattatctatgactggggttgtcagaatgcaaaaattcaaatcatcttccacataggaaactcttttctgggttctgtgtttgtgcttattatttcggtgtttcccttttaactgttttcagaaggcatcttctgacagtggcaacatcaaactgcaaaatatcataggcttatttggtggggattttacttctggatttgttcctcttgacatgaaaaacatatattctctgcttcacatcaaaaatgtaggcttacttttaagtagctatatttttaaaatctgwgtcctgtttttgatctagtttttattatatcttgcattttacctgccatttctcttctttctcttttgttcattttacaggaaatgggagatcagagatgctcagattttttcagcgtagtttcccctaacatcacagctctctcctgtctcttttattcacagtgagacactaaagacttcccagtgagcaaatttttcacataggtgaaacttactccattaaccgctaaaactttgaagaatgattattttaatcactctggaaatacatttcacagttccttcatttgcaaagtaaactatgcataagatgtacatagaatgtatgcctatctttcacagagtcagagccagcctagtgagctttcacttttgtccatggtttggaggctgttgagctaatcagagctgttttcctgggcaccaaatgctcttatgtcttgcctctgcctaccactctcagctgccatttcctgggaccatcgctgggtctttataattctcatgttttccttattgtaatgacagctggccgagttcacgttcaagtttacctccacctcttctataggtaaacgtctcccagcttcagtactctagagccactgtcttgcagttccatgctcctgttaggttctggtaggtaggaacctgacttctggctaaagggaataggggatgtaatactaagttgtcattacaaatcccttaggccttactgatagccttgctcaggatatccattttagtttttcaactactgtgttctcatgagatggaaatcataaagccaagtgtctttgaagaattgtacttgagattcagaacaagactccatgttattttttaaagagagatacttcttttcttttttttgagacrgagtctcactctgtcgccctggctggagtgcagtggcgcgatcttgtctcattgcaagctctgcctcccgggttcatgccattctcctgtctcagcctcccgagtagctgggactacaggcaccygccaccacgcccggctaattttttgtgtttttagtagagacggggtttcactgtgttagccaggatggtctcgatctcctgacctcgtgattcccaaagtgctgggattacaggcatgacccaccgcgccaggcccaaagagagataccttttttcaagtttttgagtggctagttttgcatattaatgctaacactgaaaatagtacaacatcaattttttacgctttttatctttttcttgacaaatactagtttaagttgctatttcaaactagttcattcagggtatgaaatatacaatggggaaactttgagactcatgttacttcctgttgttagagtgcttgatttagtgctttaattactatacactactgaaacaaagtgaatatacaycaccttaggaaatcacttgttattttcttgaactgttttgtttcatctacaattacatctttatatcacatttcacaaaatactggtgattatgtggtgttctaatgagtgtgtatagataataaaactaagaaaatggagtttagatttagtggggctaccacctaaaaattaaacttgcttagttccaaatttccaattctttgatgatttgtattgtaaacaggatagtttttttattacatttacagaacatgggcatgacttgaacaaaagttgctattcttaagtaaattacttttattttatgctgtatcttgccttcttgatgttctagatggtatgtccttttagtcccactagagtctataatgctactgtagttcccagcttccagttgtcatctgtgtggtgatgccataagcattggaaagtgcactgtccttatagccagaaagcactggttccttcaccctttagctgtggctctcctccccgtcaatcctctttttttaaaagccaacgcttattgaggacttcaggttatatgctgtgtgtcacgtgttttctagatgttccttcttttaattatcacaagaagcctatgatgcaggtattagtatccacattttacaaatatgcagactcaggcccagagaggttgaataactccaaggttatccagctggttagtgacaaaggtgggrtctgaatacaggtcttacttccaaagtctgcacttgaattacctcctgtaccacctgtgctacctctgtgcctctctgaaccaactttgggttttctggaagtgagagtgacaatctcagtctcatggggttgtccaggggcacaagtgaggcgagggaggcagagcatccttgtcttatgctgcacttgagcaatataggtagtccagcctagacagtcatcttcttttcattgcatgcctttccctatttctggattatagatagcagtgtctcccacctgggccagctttatcctgacgcccagcatacaccccacctctgggttggtgtgcattgaggaagtgcaaataaagtggaatatgcctcattaagcaggaaagtagtcatgaggaaaggcatgcacttgagagccgtacctgggctctttatcttctgacagataggatcattcccaaggtcrtgagagtgcaggggattgggtgccaaccaggacactgaagagctcccggagcctgtgcatggtgtctagcccttctgtcttcaggcagtcacgtgcaagccctcccctggaaggattgtcagaccacacctgtgccactgctgctgtctcctccctgtcctcctgcaggagggtgtgtgtgtgtgttttaaatttccaatttactatggaccaagacccttgaaaaatacaatgaaaacaaatttctggaaaaatagtttttaaaaaggcattcaaaatgtaagcatagtattttattagaagattcaacagcaagaaaataacattgcaaaaatgacctggcaatgccaaattgctggaagtttctaagcacttattgtcagtmtttttcctaatctctttactgttgggtagcagttcacagactggccaggcgcggtggctcacgcctgtaatcccagcactttgggagtccaaggcgggtggatcacaaggtcaggaatttgagaccagcctgaccaacatggtgaaaccccgtctctactgaaaatacaaaaaaaattagctgggtgtggtggcacatgcctgtaatcccagctactcaggaggctgaggcaggagaatcgcttgaaccggggaggtggaggttgcagtgagctaagatcgcgccactgcactccagcctgggtgacagagagagactctgtctcaaaaacaaacaaacaaacaaagaaacaaaaaacagttcacagaccaccaccagtgcacagactgccggcccagagcctaccctgactgaggtgggcacttcatatgtgaatgcaggtccacctgccgaggggctggaggtgtgcttgctgctgtaaacttgctctgtggaatgcrtgcgcaagccccaggccacagtgcccgtggaagcgccacttccctgctgcccttcatgacaccactgcccttgtgacttggcctctacctcagctccagtttcattctgtttgcctggtgctggagctcattcctgaacctaactggtttagtggctgtggtactgagagggtcttccagcgtccctccccgaggcctagattctgttgtctggatgcctagctgttggccaggattctaatccaatgttttagtttcctcttgttgctgcaacaaattgccgcaaatttaatgacttaaaacaacaaaacattattctcttgtagctctggaggccagaaattcaaaatgaatcttatgggataaaaccaaggtgttggcagggctgactccttctggaggctctagggcagaaatcactcttgcctcttcccagcttctggtggctgccagcattctgtagcctacggccaccttatcccagtctctgcctccatggtcacattgccttttcctcttctgttgccaaatctccattcgcctccctcttatgagaacacttttgattagaggtaggccccccaccccagtaatccaaaatgatctttccaccttaaggttcttaacacaatcacacttgcaaagtcctttttgccctgcaaggtggcattcataagttccagggatcaggacctggatctctttggagggtattattcagcctaccacgacaatgcttgggaatttgtgtcattatcacttcaccccctgtaaattttgcttctactgtgcgctactccaacccctaccccacctcaactggactacctggtatatgggatcatttgtgggagcgatctgaggttttcagagtctgggggtgttggtggcagctaatacttagtaatgtgtgtttcagattctctgctaaggactttatatactatcccatttaacagtcacgtcaacccaagaggtactgtggcctggggaagccacatgcaatcctgttcagcctgacttcagagccagagtccttacctgctaactgccccgtggacagaggcagaccctgtgatttgggcttaatttaagcacgtctcttccccacagggagcagccacatggcagtcctagtgctccagcctggccctgtggtcccagcttcttttctttcccagatagcctgcaggatgcaccttcccaagagtggacagccaggatgagcttattcagctctctcccagcaggataagtgcagctcaggaacccaagcagaggactgtgtgaataaccctgagtttccaggcaatctggctctcagcccccacactgcgctgccccttggacagtcagggagttggcagtcagcagacgctggctgagtttggatttgtttgctgatcctgtcatgatatgtcattaaacattcctggctggaagtcagacatgagagtgctggagggtgttctcacacccctgtgctgtggggaggccttcccttctttctggctgccctggtaccctctagagcctcctatctgctgctcggaggcagtgcctgcagcggctggactcctgcagcagctggagktggaggaaagattcttaggccgtgagtcctcttcttccgacagcgaatttgagccctggtggagcaatgtccggcacgctcaggaaagtgtgaaatctagaactctctgtagtggcctgaggcaatagtcagacatggctggtaragctgtgctgcctcagaagtcatcctggataagctgctctggatccccatcgtggaagcataaaatgtcaagcagaaggatgttatgagaattggaacctaagccctgtgctgacctcggggagcactccctggggctacctttgctgggaggtgcctggcccagacctgtccaacctgggcctgcagccaggaacattctcccagagtagcaatcttattaaattccctgtaatatacatgttttaataataaaagtatggatatattattgatgaggatacaaatagctttacgtcttttacattatgtaagtaagcactgaagttatttcttttttaaaaaaatagacttaatttttttacagcatttttagattcacagcagaattttgcagaaagtagagttctcatatattcgaaaccctgcaccaccccccactccctggagccatatgcacagcctcttccactgtcaacatcccccaccagagtggtacatttgttacaattgatgagccaacactgacaacaacataatcatccagagtccatagtttacattagggttcactcttgatgttgtaccttctggggagtttgacaggtatacaccactgtagtatcatccagaaaagtttcactgccctaaaaatcctctgtgccccacctattcatctctcccttcccactaattcctgacaaccactgatctttttaatatctctacagttttgccttttccagaatgttatatggttggaatcatacagtatatggccttttcggattgacttgactcctttcacttagtaatatgygtttaaggttcctccatgtcttttcatgggttgacaaactatttctttttagtgctgagtaatattccatcattagaatgtaccacagtttatttatccagccacctactgaaagacagcttagtttctccaagtttgggcaattatgaataaagctgctgtaaacatctgtgtgcacgttttgtgtagacataaattttcaggttatctgagtaaatatcaaggaatgcaatttgctggattatatggaaagagtatgtttagttttgtaggaaaccaagtcttccaaagtgactctaccattttgcattttcactgacaatgaattagagttcctgatgctccatgtccttcccagcatttagtggtgtcagtgcttgcaatttttccattataataggtgtatactggtatttcattgttgttttaatttgcatttccctaatgatatgatgcagagcatcttttcacatgcttatttgacatctgtgtatcttctttggtgaggtgtcttttcagattttacccatttattaataggttgttcattttcttatggttgagttttaagagttctttgtgaattttggttaacagtcatttatcaaaataattttccaaatattttcttcctgtctgtgatgtcttcccattctcttgacagtatcttttgcagagcagaaatttttaactttgaattaagtctaacttatcaattacttctttcatggtcatgcctttggtgtcatacctaaaaagtcattgccaaactcaagattgtttagatttcccctatgctatcttctaggagttttatagttttgcatattacatttaggttagatttcctttttataaactttttgattgaagaataatatgcaaacaaaagtttaaaagtcataagtatacaagttgatgaattatcacaaagtgaacacattcataactatcacacaggttaagcaatagaaccagtacttcagaagcctctcttgtcccctttctcaatcatagctccctccctttctattcacacttttaaaaccatagggtaatgttgcctgtttttgaacgttaagtaaaatgaagtaatatagcatatactattttatgtctggcttcttttgcttaatgttacatttcagaaataatccatcttattgggtgttgcagtgtttaatacattttcattgccatgtagtcttccattatgtgattacatcacaattcaatgttaatggacatttgagatgtttccatttggagctgtcatgaataatgctgctgtaaacattcttggacatatcttttggtgctcactggrcacattcctattgggtatttacctaagatagatagtgagtgtcactatatttccagtttgtgccccactgtcccagcttatgcctagacgtccagagtaataattttcctccctttcattttcagaagtgtcccagtttggctaataaatgaattatgtcttttgatgaatagaaatgtaatgtagtccaagaaatcttttcctaccccgaagtcatgaagacagatgcctgtataatcttttagaagtcttattgttttagtttttacagtattttatgttcacctagataaaataaccttttatatttaccacttgtatgctctttattcactcctcaacagtcaggtttccttctggtatcatttcctttaatctgaaataattattgtcatatttcttataacgaagatctgtgggcaatgaactgtccttagttttactttgtccagaaatgtcttaacttgaaagctgttkttcctgttttctgtttccgtagtttctcatgaaaatttascagtcatctgaatcattgtcccactgtgtgtattgtgtagtttttctcgggccgcttttgtctttggctttcagcagattaattacaatgtgcctaaacatagttttctttgtatttttcctgtctgtcatttgttgactccttaaatctgtaaatatatgccattcagcaaatttggaaaatttcccatctatttttttcccaaatgcttttatctcctctcacttttctccacctgggacttcaattactaatgttaggcattttgatactgcccacagatccctaggtctctgtttatttttttcaatctttttctctgttcttcagattggacaatttgtattgatgtattcatgttcagagactttttcctccctaatctctagtctgttattaatcccatacagtgaatatttatttccaatattgtattttttcagttctaaaattctcatttgttcttacgttttctatttttggctgagagttcttctttatttgttatgagttttttctttatttttctgcactgaggttaatcataatagtgatattaaagtctttgggaattccaacatctgggtcatctcagggttgccattatgtttcttaggtgatgtgatttgggattgtatcatgggcattgtgaatgatatgttgtggaggctctttattgtttcattttagcaggcgattagcttgattacactcacagtgtaaacatgatgtcacctgaggtgggtggcagctcaaatctcagttcagagatttttaaatttttagttggactccttaaaatcttccctgtgcatgaacagttccaggatcagccagagatgtgagcagagtttgtacacaaaatttaggttccctcctcattctctagtaactctggttgccccaggctccatcttctggttccttaggcaagattgatggtaggttctccatcacagttggaccgtcccatgccgtggtgtgactgtggcctgccctcatggcaaaactgaaaaactaggtaactcaccagatgctagattccttctccagatctttctccaaatctgcctgcttttgttcacgctccagagcccttaggttgtcattttttgtgtgttttgttaaagtgtgttgttgttatcagtgagagggttggtggttataggaatttactcgttcttactggaagaggaccccagttcattgacattaaatataattagtcatgtatttgcatttaatgctgctatcttactatttatattatacccacctattctattcagaatgtttttcttatcttgatttctatccatttaaatattttccatttcctccccttttagcttattagttaactccctgtttataccctttttgtaattagtagaaattacaaaattacttttaccttgttaacccaatgttaatatctctacccttctttaacacagtagaaggaatgtagaatacttaaattccagttatttccctccggattccatgctcctgttgtcgtgcattttaattctatgtatttttaaatcccagaagaaattactgtcattttctacactcaatattcatttagatttacacacaaatttaccttttctaaatgacattattttctccatctgtgagcttccatctgagatcatttgccttctttctaaagaccaccctttattattattttttttagtgcaatagttctagtaacaaattctctgtttttgtttgtctggaaattcttttattattattattattattgaagtatatttttactaagtatagagttccaggttgccacgtattttatttcagcattttgaagatatcatttcattgtgtcccacctcccattatttctgtttttccttggctatttttaaacgtttttcacctatattttgcttttaccagttcttctttaatgcacttaggtatttttttttcttcatatttttttttctctttagggcctacagtgcttcttgactttgcagcttgatttgtttcttcaatattggaatattctccaccattttctcttcaaatattgttcctgacgcgttctctctaatcctactgagagtgaaattacatgtatgtgacaccttttctctgtgtcctggatgcctctcacattcttcttatatttgccatccttttgtctccctgcaccttagtctggatctttttctttttttctgacatatattccagttccccagttctctgttcactgtgtctaatatccatataaacccatccatctggtaactgattttaacaatggtagttttatgactaaaatttccacttgatttttaaaatgttttctagttctttgtcaaaatgttgtttcttgtcttttaattctttgracatattttcaagtctgtgtgtgtaaccctagtatctggatcttccacgtgtctgtttaatgttttttccctctcttggcttttggtcaacctttttttcccttataactgcttatttcttctgagcattggattttaaatttagagataatttgatgctctgaatgatggcatattcccgcagacagaatttagttttccttctagttggcagctgggaaggggacaggcgataataactcagtgactgagatgagtcaaagaaccatttcgtcctatgtgaaggctggcctatctccaggtcaattctgttcctagattgcagctcattggggtccccattgaaaacctaacatgtttgccaaggtcctcactctctgatgggccctgaactccagttttatccttccatttctgtgtggtggatggaagctctgctcagcttctcggcttctggaattgtcagtggccttcaggggatatggacaccaaaagccacattttccttcttgccttcctttctctcgcagatcttggtctgacaaagtctcactgcactggtatctatctgatactttcaaatagatttttaaaacttctttccaatttctctagttattcttattggagagtcggcccaagaaaagtaaggttcagagagaataaataaattgtccagggtcatacagaccctgaaagtagaatctctatgaaatctatttaaataggtggcacaagaccagagaaatctgagacttacagcagcctgcatgcccagccttcaccatcctttgtcatttgggtattaagtttgacagttgctatgtttaactctcttgttttacaaaactgatatccatagagatggtgtgatttgtccatgaccacacagcgaggtaatatgtgagttggggtaaaatctaggtctgtgctcctcggttttttcctgttaaatcttgctgcccccatctttttttttttttttttttttattgttacttaggtacccagacctacatcccagctttagtaagacatctcagtgctcagtggtccaagaagattcttctcatttgtagaaaattgtccttgatttatgcagccacaaccacatatgagtgtcacctgttaccttcttttttcccctctttcttcgcttctctttttatctctgaatttttacattgccactgacatcttgcctgtggctaatagacacgtccacactgagagacatgctctagtagagtgggttcaggactgcataattagtttgtcctcttttatgcctgggaatattatatcagattctctaaaaggttttgaaacgtaaggtgaaaagggaaatgataaaataaggcatttgagatttttaaactcatgatcagctgcttcccttgaaaataattcataatctcttccagaattgcttgtaaaggcttttaacttttgtggtttatctgctgttctcttaagcacatggtatatatttataggttcttaccttaaattttaggcagaatcatgaattagatactgggaataaagctgaccagaagtaaatcatttcccacatcttatctttgtaaggcctgaaaatgtgatattccacgctgtttttgaagagaaagcattttggtggttaccaggaggaaagaatggggcaggttggaagtgtcactggtctggcagcctggagacctcaattttatcccattgtgacctctcacttatgtgcgaccttggacacatcacatacaatttaggccttatttggcaatatgtaaaatgaaaaggttggacaagataccccttgggagccttacaattctcaaatttttggaaaactatcctttactgtgaggccagtgtctggaacagcattttgtaatatgaatgaggacttaaagcaattttttatttcctgtgatcttgtgggaagagggtgggtaaagttagataatctagaagttgacatttgtgttttcatgtaagcaagtcaaatgttctggactacattttgtttcaagctaaagagcttatgctgtgatgacccagcttattaagttagataacaaatgtaaggcacctatttcatttccttatcactgtggggctcagtaaggagtttccaaaagaatgaatgagagattatcatcataatatctatcacttatcaactgcctgctgtgccaagatacatccgtgagtaatacagatttggcatctgtcctctccaaggggtaagtattattacccctagttccacgtgtggaaaatgaattccaatctggtcttacattaaaaaccattgatgtggcgcctgcctcgcgcactgtgtgtgcacgctgcaaagaccagcaagctccttggaccttggagcaggcctgctgccttcatgtccactctcctcatcaatcagccccagtatgcatggctgaaagaggtggggctccgagaggaaaatgagggcgtgtataatggaagctggggaggccggggagaggttattatgacctgttgctctgctaacaactagccaatagcaagagtccgacaggccagtgtggcagactatgaagaaactgtaaagaaagcaacagaagcatggaaaatctgggcagatattcctgctccaaaacgaggagaaatagtaagacagattgacgatgccttgtrggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagacctggccatgcactgattgagcagtggaatcctgtaggcctggttggaatcatcacggcattcaatttccctgtggcagtgtatggttggaacaacgccattgtcatgatctgtggaaatgtctgcctctggaaaggagctccaaccacttccctcattagtgtggctgtcacaaagataatagccaaggttctggaggacaacaagctgcttggtgcaatttgttccttgacttgtggtggagcagataccggcacagcaatggccaaagatgaacgagtgaacctgctgtccttcaccgggagcactcaggtgggaaaacagatggccctgatggtgcaggagaggtttgggagaagtttgttggaacttggaggaaacagtaccattattgcctttgaagatgcagacctcagcttagttgttccatcagctctcttcactgctgtgggaatagctggccagargtgtaccactgcgaggcgactgtttgtacatgaaagcatccatcatgaggttgtaaacagacttaaaaaggcctacgcacagatccgagttgggaacccatgggaccctaatgttctctatgggccactccacaccaagcaggcagtgagcatgtttcttggagcagcggaagaagcaaagaaagaaggtagcacagtggtctatgggggcaaggttatggatcgccctggaaattatgtagaaccgacaattgtgacaggtcttgcccacgatgcatccattgcacacacagagacttttgctccgattctgtatgtctttaaattcaagaatgaagaagaggtctttgcatggaatactgaagtaaaacagagactttcaagtagcaactttaccaaagatctgggcagaatctttcgctggcttggacctaaaggatcagactgtggcactgtaaatgtcaacattccaacaagtggggctgagattggaggtgcctttgkaggagaaaagcacactggtggtggcagggaatctggcagtgatgcctggaaacagtacatgagaaggtctacttgtactatcaactacagtaaagactttcctctggcccaaggaatcaagtttcagtaaaggtgttttagatgaacatcccttaatttgaggtgttcggcagctgtttttgaagaagacaaagaarattaaagttttccttgaataaatgcattattatgactgtgacagtgactaatccccctatgaccccaaagccctgattaaatcaaaagactccttttttaaaaatcaaaataaaattgttacaacattaaaaaaaaaaaaaaccatttaccacttagcaacattggcagctttagttctccagcagcctacatacattttgtgctaaggagcaaagtaatcttccatttaccaagagctttttttgctttttaatgatgtattaaattaaacacccactcaccaaatatctgtgagtgttggttgcgcagatggatttgagtgtttggtgctggggtgcatcttgtcacagctgatcacttactggttctctgactgtggctgggtggagttggcatctgtctcctaggttcctcctgcccccaacagtttgtggttatggtgataaaattattgtgtgayaaatatcatggcagacatataaacagaggaaaggggacagcaattgaaagagtatcaaacacactttaaggttctaactgtttcagttaccaaggctcaggaaggcgtatgttgtgtgttaagggatccagagtcactcagacagtgttcctctccctctagcagggtatgaaactactaatggccccagaccctcatcatcactgtgaaattcactgtaaaatctttggaattttgatgagtcaaaagtggaatctggttattttgatttgcatttttggattgccagagaggctgagcattgctgcctggttttacagcccatttgtgtatttgttttgagcattgcttgtccttttcttgaccctttttaattgggatgttcgcctgttttattattgtcttagtagagrttcaaaaaactctaataaggatgccaatccctttactatcatatattactaatattttttctcagttttgtatttaaatatttattatgctttttaatatgtttttcttactaaaaacctaacaatcttttcttggtttatgtctttgatgttatttttaacaaaaggcttccgggcccttgaatgctggaaatgttcacttaaattgtttttcaatattctcatgggattttttttctcatttaaaattttaatctatctggaagtaatttgggtatatgtcatgatgcatagagctgacttaatttttctccatatagttaaccagttatctcaatattattattgaattatccattactttctcactgatataaaatgacatttttattacataataaatcacatatatcgctttatatatatgtatagatatgtgtaaaattgggtcagttctagattttatctttttgttgatctctctgctggaagcatactattttgatagttgtatctttgaagtattattgtcacaactggcagagcaaaatacttgtaactcttcacagttttattagccagtggctggaatttattcctctatatggatttgagaatcatttcacaagtttaaaaagttgtgccagtgtatttatagcaattagtatataggttaatttgagagagacttagcatttttttagtactggttttccacccaggaaaacagcatctcattccatttatttcagtcatattttctgacactcagatagtctgagtgtgcgatatgatgtgttaaggcacaggttctggagtcagagagtctcagttcaaatccaagtctagccatttattagcttgtatatcagtgaaaggttttccccagtgagtgggacatagtgttgctcagtaaacatttgttgaagaaatgtttgaatgaaataatttattcctaaattttttgtttttgcagttgtgaatgagttttagtctgcatgcttgccagcaattaacattgtcagttttttagattttagcccttctactaggtgtgttttaattagtaattccctggtgacaaatgatggcaagcatcttctttggtgaggtgtctgttcagatcttttgtccatttgttaattgggtgtttgttttcttaatgttgagttttcartgttctttgtgtatgttggatataagtccggtatcacatttatgtttgaaaatattctctcctcatatgtggtttgtgtttttattcttcccacagcttattttgaaagcagaagtttttaatgttaatataatccaatttactatttttttctttcatggatcctgctctgtagtataattttaagccccttatatcaactcataaaaacagacagggcaataatgtaaattgacagagcacacagtccataagcagcatctttcataaaactaaggattagagtatatgtctataaactaaaaaatatgagcagttagggccaaaccactgaccgtaacaaggaagtctgcaggaggaagcagctggcagacaaacagacttctggggatcccagggctggggacccagaaacttctctcaacacttgtcccaagaaggggacagtcccccaggagtggagggcttgctgttgatgtgaacacattcgcttaaagtggagggggcttcccaggctccagttggcaaacagtaaggacaaatgagaaaagtatgcccacaaagcagaagagaaactgcaacctaatatttcaaatgagctaaaagaaattaagaaaatgattaaaagttacaaaagaacaggacgaatgcaaattaaaaaaaacacaggttacatcattagacaacagaaaaatatgaaagggaattgattactcagaaaagaaatagaaataaaagcaaaaaaaaatctaggaaaggaaggtcgaactggaagaaatataagagtgaataaacagtgcagaaagcactgtatagaaattggaaaggaagaagaaaaacacagaaataaagaagacaagaaactatttgagaagtgatagaatgcaagacaggcaaaggagctccacaaatatatgatgattcattatataatatatatatgatatatataatatatattatatctatctagataggtccacatatataatacatatacatatataactcctctatataataggagcctctgaagagaaaaaaccaaaccccgttgtgtactgggaaaatcaatccaaaaggacaacatcaatgcatattctagtaacataattgcactataaaggaaaaaagtcttttggggcatctaggcaaaaagaccaagtcgtttataaggaaaagaaatcagattggcatcagaacctgagagcaatgctttaagccaggaaatactggagaagatatgttaaagataatctagaaaagaaaaagtgagccaattattctacattcagccaaactggaccctcaaatataagaaccacagacaaaactgtgcgaacatgccagacctyggggaatgaatttcccattaacccttcttgaggaaccttctgacaattactgtgactggagaaactttagcataaggactggtggttgacacgtgagactttggggtacgttagcttctggtgagacccctggctttctcagaattccataagtgttcttgatccaaagacagctgtaaaaagtggttctatgatcccttggttggaataccatttctcctctgctcaggtgttggctttgactccagtcatttggcttgtgattatttcatatccctccttttaagaagccacacaccaatgcacctgtagcttgtgtggccaattgcccacccaaaggatacatatcatcagatctctctaatatcaacaaggggaagtcatttgtttccattgagattctttctgtttaaacacaggagagctcattcaaccttatttaataaggagaaaaaagscaattaattggctcacctaactgaaaaatccagagttagatatggctttgggcaagtcttgatctggtaatttggaagtgttacaaaggatcttgtttctttccatttctccactctgctttccatggtgttgctttcrttctcacatggtgtcaagatgttacgagaaacaacctcactacacatttctttttgataaacagtgagaatatttattaaaagtagaatagctttttcccagcattgctagcaaaatcctgggataaactgagtggactagcccaagtcaaatgactacccctaaccaattgctgtagcagtccaagtcacgtgactactcctaaccaattgctatagccaggaaaatgaaatgcttagttatggttacctgtcctcctcttcttcctcctcctcctcttcttcatcatcttcttcttttttcttctttttttcttctttctctccctccttttcctcctcatcttccttctcttcgttttcctcttcttctttctctccttctccttcttcttctttcttctttcttcttcttgtttcactctgtcacccaggctggagtgcagtggtataaacatggctcactgcagcctcaacttcctgggctcaagcaattctcccacctcagcctcctgagtagctgggactacagatatacaccaccgtgcctggctaatcttttttacttttggtagaaatagtgtctcaccatgttacctaggctggtcttgaactcttggctccccaaaagctgggattataagtgtgagccaccgctcccagcccacatgtctttagaaccaaacagagatttccaaacagaagtcagtgactcctggaaggagaaaggaaggaatggactggggaggctatctaaaaaagaatttttaaacgtgttgaattttatcaaagtgctatcttgacatttcttgagatgatcatatattgactcttattgattgtggtgagttatgtaaatagatactctaagttagggaaggcaacctacttagctgtgctctgtgggagtaactgaggttctgggagaatctgcttgtttccccttttcttctctttttccttcttccagctcttatgtgtacttctctgcctctcctcaaccctctgatactggtgttctccagagttctgtctttggtcttctgytgtgagtgatggcaaggttttaactgcctttcctgtatgctggtgtcactctccctgagcttcatacttacatatcccagagcctgactttgcattttgaaaggactagagacatctcaaactcagtacaaaggcaggggcctttgtactgtgtcatctcatggagaaggtagaaagggcaagtgagtgtgggagacagaacaaagaaagcaagcggaattcatccttttatcaagagccctctcctgtgataactaacccactctcaagataacagcattaatccattcctgagggcagagccccatgacctaatcacgtcttaaagatcccacctcttaatatagtcaaaatggcgactraatttcaacatgaattttggaggggaaattcaaatcatagcacccctcaccactrctcctagtgtagacactcatcatcttttgtcaacaccagtagttcccaaactttagcaagcatcacattcatctggaaggccagtcattacacactgggcccacccctagagtttctgattcaatagatctcggatggggcctgaatgtttccccttctaataagttccatgtgatgctgatgctgctggttcagggaccacaccttgagaaccacggggatcattgcaggaactcctttctgatctctgttcctcccttagtctatgcacatttcaaccagagtgatccagccaactacaatccagctatgctacacctttgtccacctagcaaagcccaggcttctcaccacagmagccttctgtgacctggctccttcctccctctctagccacatggtctgttccacattgcctgggactgttcacacaaactctgttctttgccatccttgtgccattccatctgccaaaaatgctccttccatcggtcttcacttggctcattctcactgatccttcaacattgatctccagtgtggtttcctggaaatttgcctgaatccccagattgagctaagttgcccttaggtttctctggcttcatggtcatctcactcccactctgctccccactcctgtcttcagactgtgggctttttgaaggcgtgaacactcagtcttgcttatcttttttggcttattttctgtgtagtatctggcacataatagatgcttgatgaaagtttgtggatctaaactaaatattggtgctactcttgagtataactatctcccctcaggggccctgccacccatatgctagtacctgcctcccatcataaggaaacagtgccttttaggcattgctgaaaagtakagggtctggacctcctgatactgggacttgttaccctttagacatcatttcaatcttcatatatcttcctcctgtggttagacttaaattgagggctgtgggctcagccacagaacatcatggcctctgttaccctaagtttcttcctgttcttgaaattgtgacggtttggaaagagatggggagratattgttacccacgtgacaggctgcagcaaccttgaccactaaggtcaaataagcagcattgatgaattttagcatgtgggcacccctggagggggcgaggcaagtctttctgttacaaagatgcagatttcagtgcaactgaaggcagaactttctaatgagagtataaagttgtccactggttgtttagaaagaggctggacttacaccagtagaactccaagtccacatagacccgccatttggttcaccagacaccattcccagggctgtattttagccrtctgactgtccagggatccccgggaatccttatgtgtgatgatggggctttagagactttgaactaaaatgccaaggcctcagctccgtgaattggtcttcttcctttagattggtgcttctcaaacctcttcaaatctgagggtgaagaaagtggatgcctacctccaccaggtaaagtgatctgctgcaagcattagatttttgtgaaatttcattctttagcttaaaaattcatgtgaactttgcattatactctggttttctcaactaagataaaaatattttgaaggactttgtagttaaatcactaaacttgtttcatcttgacataaaaatggatgctccactaggatgcacttgtagctttgtatgtctcctggccctatctctgcaccatcaccatttctaaagcattgcctgtcttacacaaaggccccaaggcccrtaagaaatagtaatgattttaaacaggattccaggagagtggagcccatgaatctgcattgttgcttacagaattacagcaagattgggaacatgagagttgtttttttgtttgtttgtttgtttgtttgttttattttattattattattatactttaagttttagggtacatgtgcacaatgtgcaggtttgttacatacgtatacatgtgccatgttggtgtgctgcacccattaactcgtcatttagcattaggtatatctcctaatgctatccctcccccctccccccaccccacaacagtccccggagtgtgatgttccccttcctgtgtccatgtgttcttgttgttcagttcccacctatgagtgagaacatgcggtatttggttttttgtccttgcgatagtttgctgagaatgatggtttccagtttcatccatgtccctacaaaggacatgaactcttcattttttatggctgcatagtattccatggtgtatatatgccacattttcttaatccagtctatcgttgttggacatttgggttggttccaagtctttgctattgtgaatagtgccacaataaacatacgtgtgcatgtgtctttacagcagcatgatttacaatcctttgggtatatacccagtaatggggtggctgggtcaaatggtatttctagttctagatccctgaggaatcgccacactgacttccacaatggttgaactagtttacagtcccaccaacagtgtaaaagtggaacatgagagttgtaactgaaaagcttgtgaggcagtcttctaagatcaggggctcccatgtatgcagtggagtaggccagaattgctcccagtgcctgatcaaagacacatgaagccatgttctgtgatgctagaccgtggtcagagaaccctggtgctgggcatagagtacccagtgttctgcagtgtaggcattttaatgccttgagcactgaaggtgagaacctgaggctcatcaaaatgagcaagtaggcagagctttagagttttagagcaagaatacaagggagccccttgttctcattcctctcttagacgagaatacgttactcagcctgttctgtagccaagagaagaggatgatgtcagtggatccaagatagcctgtgagtttgaaccgttttttaaaagaaatatactttgattgaacacaaaatggtcttttaggacttacttaaccctttgctgtgctttgggcattttctgttttctattccaccaatggacacagaactgtacccctttcatactctctagggtttggggagatgggagggggaattaccatgggagcccatcttcagcttagtcacctgcctgtaaacagactgcttcctttcattgctgctgcggtgcttacctctctaaatcttcaaaaataatacaaggaagaaatatagttccttgggtgttgcctcgttggcttttgatgtaaaacatagtggccccagagggtcaaggtgcagtggggattgtcttccatgtgtgttagcaaagaggaggggccaagggctgggcctaaggccttggggaccttcccaggagaagctttgccggtctcaggcttctggtgtctttgctaagcttctgaaaatgttgaggttttaattgtgtagtgtttcactcaggttgtatgtcattaggatgttaatggtgctttttatcaataactgcttggaaatcatgattgttcttgccacataagtgaaattccttttcaaaaaagtgggcatttgcattttgtggctgactttgcatgggctacttacttttaaatgggattcatttcagtgagattggtttttaaatgggaattagtgcccgacaaggattcattacccctggggccatctaatctttggacttggtgactgaaggtcatggttcatcccagcatgagtggtcctgacacaccagagtcgggaaagtgagtgtggttggattcttgatggggtaccagctgtggctaaaaatccaggtgcttcagggtcacaggtccctaatgggagattcccatggagacaagcagggaagacatttcactcttggtcctctaaggcagttctagcttatcaatgataaaattgaggacagaggcagcatgtataattgaaatccacaggaaatctctaaaactcatttttagcaggtggtttctgtttctttgcccatcaaatctatttaccagaactgctgaccatgtagcaaaatttactgatttgaatatcatccctccccactttctcccaacttcatgtaatgttcaggagaagggaaggcatcagaggcatgcaggaggatggaggtggatcagaaatgagtgcttgggtttttccacagtctggataattgcctcctgaataatcagagctagactgttctttgcttgttctctattacacaatgtaattttacatgcttgaagtcatccggcagtgtctattatcagtgrtatctctaataaaaggaaggaagtcagttgagggatgtcacgttttgaccattgcctttaaattcctgtgttctcccagtcagaccctgcatgatctttgggatcttggaatggagctgtgtttacacacactcagcctagtcatttgtggctgaattattacattatgaaagcttgatgccttgattcctgcactgcatgtacgacagaaagaattttgacataatcatagcatcgaactgcagtttggggttttttttgttttgttttgttttgttttcctcctctgaagttaaatctctctaaggcttccttgtgctggcctcctttgggtacttgtcattttgtggattatattctagaccatttttttctttccattttaatgcataatcracatcaggctgagtttttttctcatgactrtagatgacatgactatgttgtataaataatttctctttaatctgatatttgtcagggggaaatggcttctccattatactgtgccagccaagttttctgtgtttagatctgatggcatctgcatgacttctgtgtttatttttctcattacgacttcagagttagcaagacgatggcctctttatcttttctcactgccatattttccaggcacagtgggatgtagcatcccccctccactggcacagcaaagctctctgagtctagtagtagcacttcttaagaaagaccagtgacagtggggaaggaaggagagggcatgggtagggggcagtgtaagatgctgtgctggaaagcacatcactgtgtctagtgcatggggggaggttgacggtactgcctccytctttgcagcctgacctcactgtctgggtggcccactgcagcgggagcgggtgccttgtgccaaacgttgtgcacaccgacttccctacctgcttcctctttccatgctcattgtttctcagccagatctttcacatcttatttataagtcatttaaaaaccctcacctcatttaaagtctctttgtacaccatcttaaggcctttctggaacagtctgagatataagtaaatacacaaataagagcatggccttcccagtgaggcagacctgggcttaaatctcagcttcatcctctcgggtaagtggcttaacctttctgcagcataacctcttaagccatagaaaggggcccaggatgccctgtgggattgctgtgacctttacgtgagatgatgtacgtggggaattcatcagccccttttgtcttattgaggcacagtgcagttactcatcttgagcaaggtcccctgagtcccagcccaattttctagaattttattttaccaagtttcagagaaaccccatctatattctgaggaattttaaatacaacaccttattctaccaaataaagactttactggaaaaataaaaagcatgtgtagaatatttatgtagtggctaatgctccattaatgttaacaccaaaataggaaatagactttcccaataaaattaaacctaatttccatttatttggaaatatctacatatacaagaagatagwaagtttaattcagtaaacacccatgtactcactatttactgcttaaaaaaataggtcatacgctgagtgtggtgcctcatgcctgtaatcccagcacttcgggaggccaaggtggatggattgcctgagctcaggaattcaagaccagcctgggcaacacggtgaaaccccgtctctactaaaatacaaaaaattagcagggcgtagagaatttttgtgttccctactaaaatacaaaaaattagcctgtaatcccagctacttgggaggctgagacaaaagaatcacttgaacctgggaggtggaggttgcagtgagccgagatcactccactgcattctagcctgggcaacagagcaagactccatctcaaaataaataaataaataaataaataaataggtcattcacaatatagttgaagccccggcacttctctccctgaattcatcgtcccctccaccagcaggaccacttgcctcaattgggagtttgtcagcatttctttgtactgttataatatattcctaaagtctattcagtattgttttaagtatttgtaaacttcaagtggtatcctaaggtatgcatcattctaaaacttgcaattttttgttttgttgtttaactcaatgtttgtaagattcatacgttttaaatgagtaactctagttgtttcatttttactgttgtataatattctattgtatggctagtccttgatacatatatcagtttcttctggtgatattaatagactatggattcagttttctaaatttttgttacaaacaatactgctctgaatattcttgtaaatgcctcctatacaccctagagatacactcatataggaggctgaattgtcagatatatacttcttcgtcttcactagatatccccaaactgtttttcaaagttgctaaaccagtttacatgcccaccaacaatgtataagagtttctgaggggccactttcttgcctatgctagataatgtttgactcttaattctgccattctgttgataaaaatagttggatgtaggatagtatctcattgtaatttaaaatttttatcttcctgattactaatgatgatgagcatctcttcatacttatatttcctctcctgtaaatttctttttcaaatcatttccccggctttgtttttggctgtcttcttactgatgtttaaaaaaattttgttttatgttctggttactagtatttttgggtttttatgttttagatttcatctctccagctctgggcctttttctcttttattacagtgctctttgcttttttttgttttgtttttggtgaatagaagctataattttaaagtcaaagtgattaatcttttatttcatggttgtatattttgatgagtagacatttgtatgtttatgtgataaaacatcatgctgccaaattaatgtactattctaaatagtagggcataaaacataaaagtaatgaaatatgtcactggctgtgagtatcttgtaaccatgagtaatcgtccatctatattatataacagaaaaactatgaaagagatttttgattgattttgattgtaacgtagggatattgtttgggggggataattcaccaaatataaaagactttatcttcctcatgccaacattataatcttgtgtttttcrtggagctatctggaaaaaaccagtggaggtatctggaaatgaacacagatagctgtcaatgtctgggtccaggcatgatagctgagtcttgggtgggtgttgttaccttccacgaggtaagtgttccaccggtgtttgttgagtaaatggatatgtaatagagtctgcaggaggggccattaaagaagcaggaattgaagttagcaacagacaagtctgctcaaaagaatagactagtggttctcaaccctggctaaacccaaggagataaaaagttgaagacacttgggccccattcttagagattttagagattccagttatcttggtgtcaaataggacccaggcattgatatatttttaaagttccccaggtacttctaatatgaagcccaggttgagaacttctagaccagaggattggaagcaggaaggagaagggaagctcatgggctgcccagtgagctcttgggccctgaaaggtccagggtrtcagagttgccaggaggtgctggagggcagccagaccacagccaggtaaggctggaggctggagtgagggcagcgccagccagcagggcccacaactgagaggggacagaaggaagagagtgttctgggtgtgctaagcacagttggcaggggagagagggtgggatgggacagagtttcccagcatagagcagggaggcccagcctcacagtgggatcacctagaggctgcagggccagtccctttctgactggaagccagaggacagacaggggcccattaaaaaggcaaaaggcagacacaacctttgtttacccagagctcagacgaataaagaactaagtttggcctgagaatggagggtggacagggcacatattgagatcattaaatgctatttttaaatcagagccaacagggcagcagacagagttgatgaagagcatttaaaagtgcctatttctgtgcccacagctggtgtcttttcagtgtgaaatgatcttcaccgtggacccgtcacaaagtgcaagtcaagcttgccttaagctgtgtgtgtgcgaacactcagtactgtagatggtgggaaggaagggattctaaaggagaagtcattgaagtggggaagattcagactctgagttttggaactcagacattccacccccacctggacacacacgcacatgcacacgcatgcataccctttttcttcttggtgctgggccagccctgttaacagactaccaggcacaagcagggatcgccaggcactgcatcatctgttttgcagagtctgaatggagtccagaagccataccagaaagatgagtgctgcagaattaatgcttccaattttggagcataatggaagagcagtgcactgggagttaggaagaatgaagtctcaatcttcactctgttacttaaaagctgtctgttcttttcagtttaattcaattccacaaagcatttactgagcatcttgtagatgctggggataaaattgtgaaaaagacagagactatgtcctcaagaaactcacagtcttgccaaggagtgagatatttaaatgagtaacaaaatcagtgctatgaatacaggagtactgaggagagaaatcactggttcttctttgggtgaagttggacttgaaccattgtcagagggcaagggcgttggagcaggcccttgaaggatgcrttagctgctgaggcaggaaagggctttccaggtcarctgctttccttcctgaatccttagcttccctcttgtctgaggaaggctctaaaactcgatgccaagttacttaacaaaattcctgaagctgaaactattaagagctgcagcaatcacctctagagaatgtggtggcgtgacaggtgaattaaccaacctgaactaccttgatttctctcgtgagtttgcctcttccatctgcctaccctgcaccagctgggttgtatcgtggagttycctttctattgaagtgaagccaagctgagtttttttcttgatcattgcagtgtattttcccacttgctttcattgctgtagttcctactcatagtggtgtttttgtttagtttttgctaaatctctgttcttggttgttcagaaagtgggcaagccaatgtttgattttcccaagtcacagatcttattacgttaatcctttgctcaaacacctgcaatgtgattggtgcttagagattaaaaaagagagctccttcctgtgtcctctgaggatctgaccccagccttcccagtcgaccctttctcacactgcaatccagctctctggacacttgttttctccccaccagcaccttcgctttcctgcctccatgcctgtgcctgtgctgttccctatgcctagaatctccttccccaacccagtatcttcgtccccctattcttcaccacctgcctgccttcatgaagccttccttgatctccccacctcccaaaccagaagtattacctcctctttctcaacttcaaagtgggagagaaaatgtctctcaaccagaattctatattcagccaaacttcaagcaaaagtgagtgatagacgtttacagatcaacaaagactgagtgactttgccatagaccttctctgaatgaaatgatgtattcctaattttgcagtcatggacccatgttgccagcttgagatcaacaatggtatttataccacggaagtcaacaaatgctacaaaatagtacttgtgttttttttttcatgtgaaagtggattggtgaccctgcttccatgtatatatgtgtgtatgttaccattcacacatgtacacacaaatatttgacacactacgaatgttatacagcacagttaaaactacgctgtagttcagcagtccttcctcattaggctactgtggaaacacatgtggctaggaagtgtgtctctcttcacactctggtcccaccctcccctcttctcaggtgttggaattatgttacctatgcccccacccctgcatttgtttctctgaccctggcaaacttggccacttcctggaatcagagctaatacactaattgaagagtctgtgcatctgcagttgctcaaagttcattctttgaagtagagaatcttggcctggctacacagatgtcagtaaattatctcctgtttctgttcatagttgctgttttataaattggtgaaatgcaggcagttagacgcctgtgtcagaagcagaactctgcaaactgccgtctgtgaatacacctgctacaggttttttcctgctggtcactacctagtgccagccctcagagtcagcaagaacaagttccagtgttcttttgggacagttgacctcttttggacacagaagccaaggccagatgacttggagcacagaccaagaaggaaaaggcaggccaagagacacaaagcaaagtgtgggtcaggactagaggagctggtraactgaggcacccacgccggtagtgcaggtagagtgacaacacgtgggagggagcacagtgaagtgaggctgggaggagagaggcaaaggatgcaaaggatggtagagatacgagaggcaggggtttggagaatgtcccttagcagcaactttacagccccacttccgggctctgctgtcctcccacgagctcacagcatgccttcctgctgggtaggtcagacaggagttagaatactggatggcaggcagagaactgttgtggctatgagagaaagtygtagggtctttcctgcctttaggaagaaaaatgatatatcttctagcttgaaagttgcttttaaaactccatgctgtgacacagtggccattgcctgtctgcccctaggattacaggtgtgaatgcgcctggcacaatgcctgggtcagagggacttaaggaatgttcacagtcatcagatattctcctggtagagtcaaaagtcgcctgcccttccccgccagcccaccatgtaaggttagctgtatcaacacttcatgcacatattgattatttggaaaagtatacaggcaactgggcacaatggctcatgcctgtaatcccagcactttaggaggccgaggcgggcagatcacccgaggtcaggagtttgaaaccaccctggccaacatggcgaaaccccatctctactaaaaatacaaaaattagctgtaagtggtggtgggtgcctgtaatcccagccacttgggaggctgaggcaggaaaatcacttgaacccaggagatggaggttgtagtgagccaagaaggcaccactgcactccagcctgggcgacagagtgaaactctgtcagaaagaaagaaagaaagaaaaagaaagaaaggaaggaagggagggagggaggggagggaggggtggggaggggaaggagaggaaagagagagaaagaaagagagaaagaaaagtatacaggcaaggtattggttaggggtgaattattattttttggacagcctgtgcccttcttgcaggaatccttccctatctcttggccttccaatgcgagtcactttttattttattccttttaagcttctatttatgatttcattcattgctttattttctgccactgagtgactcttttaggagcctaattttgctggagaaatcattcacaggtggtcttgttggagggggcttttgtgtgtggtggaggcagtgaactcgagagatcacagggcaagcgaaaaggtaccctggcttatcaaatttatcttagtatatactaaattggtttcactttttttttttcagagtctcactctgctgcccaggctgaagtgtagtggtgtgatcttggctcactgcagcctccacctcccgagttcaagccattctcctgcctcagcctcccaagtatctgggattacaggcacccaacaccatgcctggctaatttttgtattttgagtagaaatggggtttcaccatgttggccaggctggtctcaaactcctggcctcaagtgatccacctgcctcggcctccgaaaatgctgggattacaggcatgagccaccatgcccaactggtttccctttttaatcattaaccttttttttttttttttttttttttgagatggagtttcgctcttgttgcccaggctggagcgcaatggcacggtttcggcttactgcaacctctgcctcccaggttcaagcgattctcctgcctcagcctcccaagcagctgggattacaggcgcccgccaccatgcccagctaattttttgtatttttagtagagatggggtttcaccatgttggctaggctggttttgaactcctgacttcaggtgatctgcccacctcggcctcccaaagtgctgggattacaggcgagagccaccgcatctggcccaatcattaactttttaatcagcgttctggcagttgcactgctttggaaagagggtgtctatttcaataacaaaaactggcttgggagtggagctgggtgaagggctggcagcccagtgacgcagcaggttctggtgctggtcctctcccagtagagttgctcttggggctgtgcccctaggctactggtgtcagcacccacaccttgcaggatactgacttacttagacaaaagaagagtaagagaagtccacactcaacatgagcctgtcactttgacctgaacacagcagtgaaacactgaaggaacttgttcacaggctcagggactcaaagcctccagttggttttcattgtgccaggcctgctgagtggacccatggttgaggaggctgcctccccaagaggagcagaacaggcatccttgccctcctgagaaccccccacagagggccaggaacctcagatgagcagtcattagagggctctttgagttttctgctggctggtttrgtgagaggcccaagcgccctgcatgagttctttacactgctgtgttggggtggggtrggagaatcaggcctacagaggagaagaagactggtgctttggagagtgttcatagcaccagcactaagagttaagcttggggaaaggagaagaaaggagaaagggaaattattatggtcttgcaaagtataatgtaaagaaagtttgcttttcttgtttgttttttgtaactgaaaaggctcccatggcccttgggtcactgcaagtgtctctggttgtgtaaatgctgctgcgtgctgaaggcgctccttcagactgacaaggggccagtacagagtgtggaatgcaggataagcttccaatagtgacaaatgacyacagtctcttagagaaaaacaaaattggatccatggaggtgaggtcaagaccgtcaaccaaattagtctagagaatagtcacttttagaaatctcagtaaagtaattaaaaataaagacaaatatttgctttatgcttgctaccatctaactgcttgccaaaggcagccagatggtgttggccagtgaacactgaagagccctatgctcactcctggagttgtggggcagagacaagcctctcgtggtcatcatggtgtggtgttgctcagtttatttgtggaactacaactaagatgaataatttatccatggtaaatgtgagtaagactaagctgtttgaccctcatagtaaaacatgaagataagaaaaacaagatctaaatataggaaaggctcttaaaccatacatgtgatttagcctcaagatttgagagaaatgtttattctcttttgaaatttcagaataataatggcctcagcatgatgcccagcacatagtaggtgctcaataaataattattgaattgaattcttttcttccataaaatagtacatgcttattataaaaatccagacacttctagtaaaaatgactcaaagtccaaccacttagcatttggggatgtatccttaaagacatttccaatgcatataaatggatactttttttttaatacaaaaacaggactgtgctatacatatacatcatgcttggtaacccatctccagttcagtaagctggattcttcaatttagtgcacacggtggcataatgcaatgcgttgcgtaaggaaggatgtatccatttgtgtagtttaagacttgacgcttctcttgtgctgtcctttatttagcaggtgtcttctgcggaggtgcgcatcgggcccatgagactgacgcaggaccctattcaggtacgcctcctttactcagccctgtgactcagattattttcttttttttttcttttttttttttttttgagatggagcctccttctgttgcccaggctggagtgtagaggctcagtctcggctcactgcaacctctgcctcctgggttcaagcgattctcccacctcagctacccaagtagctgggattacaggtgtgcgccaccatgcctggctaatttttgtatttttaatagtgatggggtttcaccatgttggccagactggtctcaaactcctgacctcaggtgacctgcctgcctcggcctcccagagtgctgggattacaggcgtgaaccactgtgcccggcctggctcaaattgttttcttgaagacctaaacatttccccattttgagtataaatatgatggacagattgcatggtggattgtgagaaagaacagctcttccaccccaaaactagtctgctccacatcctactgtagccagaaagggaagaagcaatgaaatggtgaagggctgggctttgccatgagtcacaactgggtgggaatcttggctctgcctttaatcagctgtgtgaccttgcatatattgcttcactcctctgacccagtgtcctgtctgcaaaatggagatgattatgcctcgggaaattgtaagttaaatgagatagcataggatgcctagaactttctctggcagttaccattaatgatagcagttgctgttgtgtgggaatagaagatgataaaatgctcccctacatcttctatgtgacttaagccaagcagcctactgggctctgtaacacagcaggaacttgtgtccaaggatacaaggcccaaccacctgtaggactgacttcactctaataatggcagcaactatgtcctccttgcagcccttccaggttccygtgcccccttaagagaaacatgtatgaagagggagtttgtacccttttaaataatttctaaatccttatctgcatataagccatcctgttaggcctaaataagttaacttcttccttgtaaaaactgtagcttattagcacctggaatcttgccctgtacttgggacaagtaaagatgcagaaaagatgtaaacaagtcaaccaacatatagatgaaagtgaaaaaccaagcaaggaaatgtgctatttgatttatgagcaaatggaaaaagaaaatagtgttttatagttgcttggaaaaagaaatgcaaatctaggaarggaaaaaaaaaaaggaagagattagcttgggaaaatttgatgaaaacaaatttaggaacagagagagagagaaaaataaacaccagccacaactatttgtatagaatacaaacaaatggaaaatttcagtaatcattctgagccatgccctttgtactccaattttgaataaaggcaataacaaataaaggcattgatatcaaggacttattcccaaagcaatttccagaatactttttgggattagtgtggttttagatcaatttcatttaccttcatttttgtcctatgctacactggcaattaatgctcataaggatgtctcattcttttaaaaatgtaagttgtcaaatgttaaaatatttcaaatattcataaaggtgcatgtgtgtaccaacacccacttctatcaaatattaatgatatgtcttatttgtttcagagttttctcagaaacaaaagattgtggatactgtttaagccctttatttatccctttgctacccctttctttcctctctgaaagcaaccactatgatacatatttgtatactcactcttcgtatgtatgtgtccattcataatatgtacacttgttttgaatactttttagctctctttgaaaggtgttgtgctatacacatcgttcttcattcatcagttggtgtcatatctaagaattcattgcctaatctaaggttgtaaacatttacttctttgttttcttctaagagttttatagttttagatcttacatttagctctatgatccattttgggttaatttttgtttatggtgtgaggtaggggctttatttttatctagttgtcttagcagcatttgttaaaaaatactcttctccattgaattgtcttggcatctttgtcgaaaatcagtcataaatgtgaggatttacttttggactctcagttctattccattgatttatatgtctgtccttatccagtaccacactgtctcgattagtgtaattttgtagtaagttttgaagttgtgaagtgtaagtcctccaacttagtctcatttttcaagattattttggctttctgtgtcccttgcatctttgtatgaattttaggaccattttgtcaatttctgtgggggcttcggggagctagctgggattttgatagggattgcaatgaatctatagaccaatttcaggagtattactatgttaacaattttgttttccagtctatgaccatgaaatatctttctattttgcaggatcttgtatcctgcaagcttgctgaactcatgtattagttttttgtgaatatagaaattcctataatcctaagcattatgtattataggattaaattccttaggattttctatgtacaagatcatggcccagtctagatgcttttttttcttctcttgccgaattgccctagctaaaacctccagaacaatggtgtgtttagctttttaagatacttctagacctttcctcaaagtacaattttacactcttaccagcaatatgagatttctggttactctaaatccttgataatatttgatgttgtgagtcttttaaattttagctattctggtggatgagtagtattatcatgatttaaatttgcatttctccatgactaatgatgagcacttttttatttgtttattggccattcctctattttcttttgtgaagcgtttggtcaagtcttctcctcattttttaattgggttaatttttaaaagttattgagttgtatgagttctttatatattcttgttatgactcctttgtcagattctgagaacattttctctcaatccgtggctcttttattcattttcataactctggcttttgaacaataatttttcattttgaagaaatctttcactttttaaaaatggttattgctttctgtgctttaaaaatctttactcccaggtcaagaagataatttgttgttttcttctagagactttattgttttaacttttaattttagatctgtaatctacctcaagttagtttttgtgtgcagtgtgatatgggtgtcaaggctgatccccccaccccaccatattaatgtctgattgtttccagctccacttattacaaagactattcttccccattgaattgctttgakgcctttgctactgattttttttatatttgttgcagcttgtttggtggccaggtatgtagtcagtttttagattaatactccacaaaaagtgataaaaagatgtattctctatttgttggacagagggtcctatttacatgaattacttcaatttcattaatcgtgctattcaaaccatctctattaatttttgacttaaattttgtgactatgtgatctatcagtttctaattacagtggatttgttgaaatcatcaatatgtgttaatacttgctggtattttgagtctgtgttgttaggtgtatccaagttcttgattattgtatattcttgatgactgtcccttttatcattacgtagtgtcctactttaaccttttcccttatattctgttttatttgttggtaatattgccaggccagctgcctttctttaacattttcctagttatctttttctgtttttttctttcagaaacaaaagattgcagatactttataactttattttgagtagcctcttttaagcagcatattggggtttttttttcaataaaaatatgggaaataaaatctgtttctataatctttgtcttttaataggtgagttaaatctgattacattgagtgtgaatactgatatagttttattttgtattttctatttattaatcttttccttttttattgtttcttgtttctgcttattatcaagttgggaatgtttttgaagttacattttcttttctctaatataggtatacttctrttcttttagtggttaccctgaaattattattactattattattgagacaaagtcttgttctgtcacccaggctggagtgcagtggcacgatctcggctcactgcaaactctgcctcctgggttcaagcgattcttctgcctcagcctcccaagtacctgggactacaggtgcatgccacccagcctggctaatttttgtattttcagtagagatggggtttcaccatattggccaggctggtctcgaacttctgacctcgtgatttgcctaccttggcctcccaaagtgctgggattacaggggtgagccaccgtgcccggcctgaaattatttttaatatgcttgcttagcagtcaaattttataacaaaatctcaccatactatctttctgtcttctcaaacatgatacagtcctttgcagaatttaagtacctcctgacagccccactctcccacaactgaaaaacacttgtctataaatttgaatgtattatatgtggcatattaaaacatacaaaaatatttttgatatgtgctcataacctatgaaacataataacaaattgaatatcataaactcataagcctgccacccagtgcaagacctggaacattaccagtgctacggtataccccattgatttccctcatgtgagtttggctccaaataacagcagatgcaagtggtaaagagtacctctttgagtgaaggacacaataattaagggtttcttttaaaaaagataataagctcaacttagaaccaaggatggcttcacatggtctcattcaaacatagagtttgactcaatgattcatgcaataagaatctactgagtacctcctatgttcagggctctatgctaagtgttgcargggagagagagaaggcaccatgttccctgaccacagagagaggtctggaaggtcagttttattgtctataacacactaactttcagtgtattgacatctagtgtttttatgcttcttctactaacattgcaattgacttagaaaaatgaagctatgtcctaatgtttttattttacttttttttctccttgaagaaaactattctgttgcttcactgcaatgccaaaaatattaattagctacatcagccagagcccttagggcttgggaggaaatggcttgataagaatatttcaggatagagttgcttttgagggtgcatttctgagctcatcaggggaaatttactcccatgtcaggaaatgtactcccatagggctccacacaccccacacagagctggcaggagcacagttaggagtggaatggattggaagtgcagagtggtgctgtggagcacgtctctcctgggtgagttgatgtgacccacagggaaagtcatrttttccaatcttggctagaaaataaaaagcagaggaagtgttatgaggcagagattcaaatcaacatgatactgtctgaaaaatcaartggccttttcttcatccatacctggaacacgtttacttccccagtgtgcagaatgtatgtgtttctgcttagagagtcccrtccccrttcccgtcatgctgggctttccaactggacatggaaatggatccccacagctgtgacctaagctttttcttagcaaggtcacacatctcctttcaaagcctggccaagatggtgaaaccccgtctttactaaaaatacaaaaattagtcgggtgtggtggcgggcatctgtaatcccagctactctggagsctgaggcagagaattgcttgaacctgggaggtggaggttgcagtgagccaagatcgcaccattgcactccagcctgggcaacagagtgagactccatctcaaaaaaaaaaaaaaaaaaaaaaaacacaacaacaacaacaaaaaccaccttattcttccatgttgtagggcatgggttttctggaaccattatattttggggattttatatagtggagatcacatggcctcatagggagctgaccttcacacattaagtgaaatgactgagggatggagatgttcagactcagtaacttgctgtggtcagcatttcttttgctgtctgtccttactgctgctaccaggttgtgtcttctacctcgtccagccagtttcaaagaaccatagagttgttaagaattttcatctaatattataggtaaaaatatttatggtgctgagagatagtaagttacttaacatagtgattacaaaggccctggggtcaggccagcctcggttcacatcttgctggcagtgcagctatggacaagttttttaaccatctaagcctcagtttccatgtctataaaatagggataatgcccaactccaaagagtttctctaaygggttattgagtgagacagtatgtttctagtgcattcagtatagtggctgscccttaraaaaytcccattaaactatagctgtaatcagcatcactttcctagggacatttaaggaaagttctcagaccattttttttcagctcaaatgaccactcccctgatcaaattggccacttgtttagtattatgcagacasagcttatgtgatctatatatgtggtctgctttagaagctccattaccaggtgtttgcttaaagccaaaccaaatattccaaaaactggatgtttaatggtagacattgacaatccatttgaagacacatagatacaccctcatttagaaataacgctagtaataatgaacacctatattgccttattcaagatgaggaaaagttagtttttgttttcatctttttttataattagccatcaccagataaagtagtttcattctaatttagctgtcaaagacagattattgctrtcctcaaaaagatatgtttcagctttctttgaggtctttgtagttacctttgaaaagcaggtatctcttgctttgtacaggtccaatgtgcacagatttcatggtttacttagataacaccagacccccaacaacatgtttcaaattgcggttacatcagtgttttaactgtgaataaatgcataaagcataaactttgcagctggctcttcagtccacaaatcactatgtaaataacaaatgtgcagcatcatcagtaacttatcgctttttttaaccataactttttttagccaaagactggttggtttctgcctatctgttattcagcctaagtacagacagcaaagcatgtagttgtgttgcctcctatctctccgtgataaacccaaatgacattatgcaaaaatagatcattgaaagagggaatgagctaacaaagatgaaagtgcaatgaagagatgcaaaatgataatgctgtgagtgaaatttgaattgaatgtaaatggacttagaggagaaatagttgactgtggaatgccgacactgctgtctttgagagattctagacatgtagctggtagaagttagtgaatgcaagttcatcaacataaatgaggacagcggtgtggcaaaaaggatgaagatgtcatagaggaagtgaagccagcaaaaaacttcacattaatgaaaggagctctggggatattgcatgatactgaaagcacagaggataaaatgtcagcagctgatccaaagttaggagtatgacaatttgccaaggcataggaaagatgctcacttcgtatcrtaacttatacaactagaagaaggtggcaagcactgtccaaactactcttgataaatttttttaaatamataaaacatcttaattttcaatgtttctaatattttaagttacagtatattaaataaattttagctttatattttttcatttccctatatatttataaccaagaataagaaaattttcagtatgttgacacaaatttttaaaggtcacaaaacaatcataatttttaccattatttattaagatagctttacatggtcattttttcatttttatttttatagaatataaaaatgcagatttcttgcatgcatatattgtgtactggctttcagtgtacccatcaccygaaaagtgaaaaatgtacccactacgtaagttttcaaccctcgtgcatggtcattattacagtctgattctactatgcaaagtgaggattgccgatagctatgttctgactacggacagaacacaagttggctgagctctgctccagaaagaggtttcctcgttgttccaggcttcagcccagatcagttctgcatcttctcctcttttgctgtgtttacaagggtacagtgagatcgatgtgacaaaactacttccttctgcttgttctcctgtgcttggattcttgtccatgctttgtttatctgtggtcaccacttattggtgcatttattataattatctgcttccttgactggagcccaggggaagagactggcctatggctatttctgtcatctttttattcccagttcttaacatcttgcataacaagtcatcgataaatattctttgaacgaatgttgaggatattattttgagcaagcacaaggtcagttagctgttactctttacagatcaagttcagttataacaccattagtaatgatttttcaaaaatatattttgcagaatcatttatatgagttaatcatttattgacctcagttaatagtcaataaatcttaaaaaatggccatgtcaaagaaatcagaaatactgatacacagaatattaaagctgaagagggaatgcattacttaagttttgttttgtttttattttttrgttgcaagtaataactgccttataccaaaaaagtacataagtaaataagaaatgtattagaaggatagtgcaattttttttttcagactccaagaaagagttgaaaagggtgggtggcttgcgaagggtgtccatgggccatctctgagccgtttgacatcagcagtttaacattcttccatcagtatctctattttttttttttttttttttttttgagatggagtttctctcttgttgcccaggctggagtgcaatggcacgatctcagctcactgcaacatctctgcctctcgggttcaagcaattctcctgcttcagcctcctgagtagctgggattacaggcatgcaccaccacgcctggctaattttgtatttttggtagagacagggtttctccatgttggtcaggctggtctcaaactcccgacctcaggtgatccacccaccttggcctcccaaagtgctgggattacaagcgtaagccaccatgcccagccaatatctctattcttaatgggccacaggtcccagttcctagcctttatgtctctctgttcaaattccaaattcccagaaacagaatatcattagcctagctatagcctgggagatgggaacaaagagtccaatwtgggctacttggatctacttctttcctggagaaggtattatttttaagagctaggcagatatttttaaaaggtgattactatagtgttttactctgaagtatatattctttattcccataaattttcactttgcttaggaattgaataattgaaaagcagtctttctaaattttttataaataggaaaaaatttaaatattagccaaagaaattctctcctgagtgccttaccatacctaaataataagatctgttggccttgcaacagatacagattttattattcaggtatggtaaggccaacagatctaggaacaattggcattgaaaaaatcattacagttcccagagcaggaggcacagcatgccacccagggccacactgggaagcaccgcagtcagtcaggaggcacagggagcgggaggagatcccgggcaagagcctccactgtggtttccatgggaaggcttgggtgaggcagggtgagcagggttaggctaggctagtcggattaatttcagaaaggtctggkacatattggtggttctagttgtctggtacctggccctagggtgattagggttggggaattgtggcctggagtgtaagagccaaaggtggtggtggttggggaatgggctctggattggttgatttgcatatgaagggcatgctcacaggagaattgtgtgctatctctaggaattagcaaccctgagaagggcagtccttccagggtcagcaaagccccagaagtcaaagcatcagaaacacagaaaataaaaatatacaattaatacagctgtccaccttcaatcagttttgtgagtttccatgtgaaatccagttttgtaacaccttcaaatgtcctagaaggccttatcatggtctagccctctgccgtgaacctgacctgctcccacccttttgccctcacaccctcccttcagtcacccaggctcccttgcagtccttagaacacaccaggggctcatagaactctgcctggaatgcttttccttccaacataaactgggcttgcttttctcttgccttcaggcatttgctcacacgtcactttctcagcaggacctattctaactgcctacttccttctgctgccggcacccactcctgacccccttactctgctctgccgggtttcacatagcacctgtcatttattaccattctgtataatgtgcttacttaatattctatttattgtgtgtgcctctaccactacaatgcaaagagtctttattttgttcrtcaacataccataagcagttaatagcagtgtttctgaaaattagtgatagctgttgtaatgcccaacaagagaattgttatattcttactgtattagtcaaagattgaggcataatggtgtcaaggaaatataaattgctgagattcttgtttagaaacccataattcagccakacaggtgagagacaagaaatgtttcaccttttttgacttctaggtttggcatattgagtttcttgtgttaataccacagctacaccaagtaaaaggttattgactttttgcaccaaccagtttattctacctgatttttctcattcaggcttccttgttaacagtttgatttgaaggctttcattatcaaaatccacaaggttgtgtccttcatttttcttgggagagccacctcctgtttcttcctggaaggaactctgtggctggaaatgttaggagcttcctgggctgaagaagttcagaccctagccagtccagggtgctcctaacaaatggcatatataatatatccagatatttattgatattaaggaattattggggaggtttagatatgaaatgatattgtggtttgttctttttaaaaaatctttatctttcacagatgcatatggatgagataaaatagctgtatttgccaccatctattataagagctaggaaaatgggtagggatagagatgaactcacattggctaggagttggttattgctgaagccgggtaaggagtacgtgagtttcattatattattgtttctacttttctatatacttccaattttcaattaatraaagtatttttcagctgggcatgtggctcatgcttgtgatcccagcactttgggaggccgaggtgggcggatcatgaggtcaggagttcgagaccagcctggccaacatggcgaaaccccatttctactaaaaaaatacaaaaattagccaggcatggtggcgggcgcctgtaatcccagctactcgggaggctgaggcaggagaatcacttgaacctgggaggtggaggttgcagtgagccgagattgtgccattgtgctctagccttggtgacaagagcaagactccatctcaaaaacaaacaaacaacaaaaaaaagtatttttcaaatgtaatagtaatgattggacaatttggcttgtttctgattttaagtgaaacacgtttggtgtttcaccatgatgaatatattgactattgactcaaaagctcttcatgttgagaaactacccttctattgttaattatttaaaccagacgtgggtgcagaagaatattgagtgccttaacgatatcttgagattactataggtttttcttattagatctattgctgggaggtggttttacatgttattcatagtaaagccctcttgcatttctcagaagaccccacaggtagttattttttcatttctcagatatttgctgaacatctaggaagtgccagcctggtgctgggcatggggggtacaagcagggaacaagccaggccgagccctcactctcctgaagcttacttctccagtgagggagatggaccataaatacataaatgagctcaggtggtggtagggtagtctgtgtctttctggctggcagagaatctgtgttcctggacccaagggatgttgagggggaaactgtgtaaagtattgctaccttcttttctgtgggtggaattgcttctcaatgaggcagttcatcaatagaagcacttttccctcgacttagctccatcagctttacatttcatgatcattctttccagattctggcaaagattggatgttaaaattcatttttgaggttgttttgagttcccttacttccttatgtctataggtattttagtgctaagttcaaagagktggcctccagggacttaaaggcaaataccacttgcaactggaatcaaatatatgtattgtaaatgtaaaccrtaatctaacctgtgttaactatctcrttaataattttacttatttaaaaacaaagctaattaggaaattagaaatacttgtaattgcagtgagtaacaatcaccaccagagtgaatgggcaccttctctgttcttattcagttctcagaactaacttatgtggcactgttctttcactcttagagcccagaaactataggccaaagaggtgaaataccttgttcaaagaccactgtaaccaactggaggagctgggatttgaaccctggtagcttccctctagaggccccatttttaaccagtataccataggcctggtcttttggttgttttggggggattgtttttggctttgttttagacagggtctcactctgttgcccagctggagtgcagtggtgcaatcatggttcactgcagcttctacctcccaggctcaagtgatcttttcatctcagcctcctgagtagtggagaccacaggcatgtgctactgtgcctggctaatttttttgtattttttgtagaggcagagttttgccatgttgccctggctggtcttgaacacctgggcttaagtagtccactgcctcagcctcccaaagagctgggattacaggcatgagccactgcgcctggccactaggcttgtttttaatagtctctatggatgatgatttatttcaagatgccctttttgttgtgtttcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcayagacaaactcagaacttcgatgcagaagcagtgtgcaggtaccttctctaatttaatatgcttagtaaatgttcactttacatcttaaaacgaatwtcatttatagatatctttagtttatttcaaatatttttaaaatatgcgttgatgtttttaarcagtgtatacagatgtctgtggtgaaagctatagctccttcctgtagatttctctctcctcttctacttttccacatttgagttgtactaaatttagaggtgtgagctgggctcccctgataacttcagggtattccccccaccctgtgtattgctcataaaaaacattaaaattcacacagttcgcattacacagatacggtttggatttaaactagctattttaatcttcattattctctcccaaaatgaacatcggaaatgtgtgaaatataaattttttcctgcctgacacagatgggtagatcccatagcaggcttcccagtcatggagtgaatgcagccacttttgcagcaacagaaaatcttccagggaccaaaaccccctgcttgtttatagaaatgcttgcactctggggaggaaacacaggcctgttcataaataaatgctcagtcrtaagagttagctctggatgaactgattcatttagcagaagtggaatgctttgaagctagatggaagaggtcactaattaaatgctagaccaagacagagtccarttgcatggggagctggaattttcttgaatgttagtaagtgaaataaaaggtgagaaaatggctttttagactttggtaccctgacaagaaattagtggattaagagaagtttcttatcgcaggcatcatcttgytattctttgatgattttcagtttcccaaagaagaatttttcttaagcatctgttttagatatgttttaatggcttcaaataatctcatctttctgcataaacatatttttctatttaatagtgtatataaatatacatatagtatatcataaaatatctggatgctatttttagtattaggaaatatttttgatgattttataatagaattgggtcttgtaaaactaagtatttctgatttttcttggccttcacttacttttcctatgtagttttgtagtagaaatatcacacttctttgttcctatatataatcacttaagataagctttacttaaaaagaaaaaaccaacaggaagaaatcttttaattcaggcaaaggcccagtttagcagataagctttacatttttctttgaatataaataaataagagttttatttcctaccaaatatatttctgtgttagctgcacagaaaaccaatagcggtctatgcagtttagaagtcagatgtacatatctggcagtgtgtttcctgaccattattggtcttgttgagggtggccagattccaaatgcttgactcccagcacacattccctggggagatgggtgggtgacacgctcctggcagatgtgcattctttgttgtcacctgtggtgctagatccctcacccttgagctaggactggaccttagcctaacatgcgtccttgagcctcagccccaccttctccttagtcctctcatccaggaagaggcctaggtctctcttaccataccggttcctttggagagatgagagaaaagagacagcagcaggaagcaacccaaaagatggaagccagtcccaaaagaaaccaagagagtgtgtgctccagcccagttatgctcattacatgtttcagcctcttgcctaaaacccacrccttaggatatagcccagcagtgtgtccatgatgcctgctggggtgggaaagactgaatgaagttgagaagtacttagtgtttccctagagataagaacatgcctctaaaacactatgtatkttttcattaggtgctaactggtatttccactgagtatccacccagtaggctcctgagtataaaataagtatagcttcaccttagcaggacctgccctgtggggtggctgactgggaagtagcctgtgctggcattggagggatattgacttatgcctcctgccccattgtgagttaatagcattttctccaaaagatctctttcaaataccatttatcaacagaggaaacttcacttcctgggaatatggcagccgatcatttccgggagccttccccccacacagtgtgagggctcaaggaacaggacatggagaaggtacattttttgagaaaggtcataaaatgttggagttgaagaggatgaagcaataygagcyggctgtcccttggggagtggtagttcaaatacattaaagtagagaggagcagaaatgcccacagccagagagaaaaacaaatgcatgttgtttcacaaattactcaggagtaattctgttcttggagatcrtggttcccttccaagatatctcagaataagcagaggccagaccaagagaataggtcaaagcaagctgctgattcacacctagattcaagtgtgtgggcctttattaaaagtttgtccaatttacaaccccctgaccagaacagtgcagaatctgggctgtagcatggcacagctaagaagtttcatggacctcaaaattctatgtcctgattattttggtcctgtttaattcctagggaataaactaactatatccaggtggtcctagtacaacaaacattatatggtgacaggtactatattgcaacatttctcagccccagctgatgatcaagttgtttaaagtatttaagcacaaactacagcaggactgaaaaattgaggtggctctttgtaccacctttaattggctttaactggcatttgtacatccagctgccagcaagtgctttaatttttatcataagctcaactttctgaactacctgctattttaaaagaaaaaagatcaaacccagtgagctcccccaggtacatactgataagaagaggattgtaggactgccaatttatttttgttttgaagagtggagtttcaattttaaaaaatggaatttaagtggaatttgccagttttttaagtggaaaattggcaggtctgacctattggataattgcctgggagttaagagaaaaaaaattttttaacgwaatgaagagattgtcctaatccacaagsgcatctttctttgttgtcttctctgtgttttgagacgttttctttagagaaagatttgatgttgtatcattttcagtgtgaagaagttccacattcatttaatgtaacaaagcccagatcaccttgtttgacttggagccttctcattgcaggtcgatccgggccacaaatccctccgagcacacggtgatcctcgcagtggtttcgcgagtgtaagtgcacctcccattcccagatggaaggagtacygttcattctgaaatatttgtcagatgtaatctggtttttgagctatctaagcaatgggtgtgtcttgggtcctagaacaccagccttagatcttgatcttgctttgggggttttgtttgtttcacaagttcctggaaatatttaggtttttctctgtatcttgtgtaattgcctttagcacctagtcatacacctcagggagaaagtttactcattatatgccaaaaatgaatggaaaatttgaggaggaggtggtctggagaaaacattgttccagtttatctcttttttttcctttgaagaaaagagatggggatatgcttgtttttcatttaagaagaaacacattttttttcatattcaagcatgagaacaaaggggcactaaatccacaagacaagggttgtgaaattgatgttgggactgatatgtggctagaggcaggacagtagagtttatccaatgctggaaggcaaagaaaagggattgcgctgtaggtgcaatgaaactgtaggatgagcgcttgctctgctgggtttatcgtctgaagtggccagcacttaaaataaaagagccagcaggaagaaaagttgtctgtgcaagctgcagtggtagaaatcttggcaggtaacaaaatttgttgtagtcttttaatggctgtatttagctttgcagagaataagaccttatttaggacctaggacctattggatttggctgcattatggcatttggcacaaattctgcgacaaaggccaggaaagtctggcccaggggacttgaaatgcctcattccaaagccatgtggatacaacaggaaatcatggctkcaaagtcttaccctcactgaagactcctacttacctgctactccttgagtgtctccctaggggctatgtcttctcactttgtttgatacccaccatgggatgtggtccagagaaagcagagacattgtcctcactggttcattacacctctccatcctggtgggagattaagattccacagggaatgaatgaggggaactgagacataagatcagcatccttcagccctcttttttacatttatcttctggacactctgagatctgaatgaggtcatagagtcttggacatcaataccagaaatgttcaaggccacacagcatttttcccaagcctggctattacacgggtccaagaacaaaatactcttgtttttctgactcatatggcaaaaaggtttgctagtccttgacaaataatggttgactatggcttatttgttatgatgtcaccgatttttcctggtttaattatacaatagttcatatagagagagtagtaataaaatgaatgtgtgtgtctatgtcacccacttaagaaataaaacattattaatacccttggaaccctttttgtggccttcctaacagtcagagaagatagaatttggagttccagaagaaaaagaaagtgggtaaaatagcttttcccttagggcaggaatcagctgtgggtaatgccacaagtcagcactgggacttctgttcctgttttctatctgcgtttccacccaatcccttttattccatttttcttccctggttcttaggatatgtcccccatgttacttgctggctgtctcagacactgtttctctatcttggtgatagagagcccagtgatggcatgtcttcatgacaagccaatccacatcccaccttgtactcaaactaaagtcctgagactcagcagtaagctcactatagcaaaccctcttgtgaaatgagtagcaattatccatttttgttttctctccttcccttctaactgtgtgttcctgctgatacttctctcccatttggattgggggtcttgcagcctggaatgctggctgtcttcctcatgttgagagctggaccagctcggttttggtgtgggagtcatacttccagatggtttgggaacaattgtctccgaatgaacagtgcacgtaacatgtccctttatgggactgctcccatacatgtggctcaaccccaaagggcagctgagttggaaagggccattcatgtgtactgagggtgatacctccaggtacactgctggagctttctctgctgtttttgttctttttgcatctggaaggtagatgtggggtctgtatccttgaaggcaggtgtgccccgtgggcacgtgctcgtcaggaagccactcttggagctaacgctgtgtggcctcattgctctctctccgtgtttcagtgtgaggaatcctggtttgtatctgctgagtgaccacattttctgctttgctgcagatcggatgaccatgaagaggcgtcagtccttcctcttctccacgcaggcttcaacagggtatgtacaagatatccagcatctctctcagttgcaggcaccttaacccctaactctcccataacagggaagcaaagctgccacggagaactgttaaggaaattaagccccaggactgttggggaaaggaagaaactgtgttctcatgggaragtaacgagcagctgccagtcgagctctttgcgtttttgctctctgggttatttccatatatcttagcaatagatatacaatgacataaaaacacatcttattatatcagactaaaattctgtcatcctaaagtaataaagtaatcttatttaaatcagtacagtcaattcgatttaatgtgtgtgtgatcatacatagatacatccaccaaattggcacccaagattctgttcatcagggctggccagagcttctaccctagggacaggcccatgatgactgtagcatcctgtaaactcccggttgaaaccattaacatcagcaaagaaaaattctttgagtgacaaactacacaaataacactgagattccacttgaagattaagaattactccaaggaaactcactaacaaactaaataaccaagctcacccagcatctcagggtagaaattagattggaggcaaagctgtgtgcctgcaaatggaaaggaactgatagaatggacttaaaagagaagaaagagaagaaagggaggaggaaaaagattatcaaaacatgaatgtttaaaagaactatattccctaatattaaaaagaaaacaagtccttatagagaaattgtggaagaccttacttcatattttaatttttttaaataacaaatatatatattactcctatgtaaaaagtaaaaggtttcccttaggagaataataggatagaggaccatggtttacttatacagcttttgctgataatctaaacgcaagtaatcctatagcatcctgtgacctcctggcttaaactataaacatcatgaataacactgatattcaacttgaagattaagattggttactccaaagagacttaccaaaaaaactaagtaactaggcatacccagtgtctcaagatctcttggtaagagtaatctgaatcccggccgggcacggtggctcacgcctgtaatcccagcactttgggaggccaaggcaggcagatcacctgaggttgggagttcgagaccagcctgaccaacgtggagaaaccctgcccctactaaaaatacaaaattagctgggcgtggtggcacatgcctataatcccagctactcaggaggctgaggcaggaaaatagcttgaacccaggaggtggaggttgcggtgagccaagattgcaacattgcactccagcctggacaagaagagtaaaactccgtctcaaaaaaaaaaaaaaaaagagtaatctgaatcccaagtaggtggagtgatgtatttcttaaaaaatagggtactgcgtgtgccttgtgaattatgaaaatcctctgtgtgctttaagtaatggtactttgctactcctggcttaaaaatatatatatatattcctgttagttgtagaccacagagaagcaaaaactacctttgtgatgcagttgttttgtgctttggtatgcttcagtgtggaagaaagtgctatagagaagattcaaggtagtctagtggctcacgatgcgtgatagaaatgaatgtttccagctagcaatatttttcacgctcctaacacttttttcttgtctgttatctcttctcacaaaggttggcatttggttctgaaagctattcttaggtgctatatcttaatgagaatgcatgagacaatgcttctgagtttttggaatgaagagttgcaaaagaaaaatcagcaaagaagccatgtggttgagacagattttctttactcactcattttctaagaaatagctctaaaattattcacaggcttcatagaacttctgtgtaatattgaccccccgactctaccccattccaatgtcatccttttcaagtttgagttgggacctcatggagtgtgaggacatagattttcctcattacctaggagatgattggagaatggcaatgacacactgtgggttttatcgatcaggacccatgtacgtgctgttgagtgtccttttggaattctacctttagttcagtgatccaacctcaaactggtctagaattgctgccatctgaagcgatagcatcttgtctggaaggctgagattgcacatctgctcacagttaggagaaacaacwggaactctttgggtgcaaatgctattgagaaaatttaaccaaagttccattgtttccttcttacacattttacaacctgtccatggggctctggaaggcttcatttgccactatccagacatgttactgtgttttgcagtcagcctcagtgaataaagctttgggggaggggcatgaacagcggtagctgtcagggaccacctggtgttcttcagtgctggccctgatagaggccatttgcccattaggtcagggtgcccccagtagcttgggctcattccaggagaagcaygctgcacctacaacagctctcctggcattactgtggcacaccatcagctgagactgatcttcatgtggtggttctccttttttgggcaaaatcctgtctttcacaactctcttcccaagcaccttttcaaatatgccagttatctttgccttccatgaagttgtttcccatctctgagctggtttgattgtattagattatctgctgaaactcacccctgtgttgctagctaattggctggtgcttcagtctgtggtccctgagtggggatctaggaacaaattgtgccatcacatatcccacaacaactccccttgaaggctctggagctatgtgtaagcagccgactatatagatgctaattccatgctgagccttttagaaaccagcatcttagcaaaggacagttgcaactgtttttatatcaactttatgtgcctctttttctatttgcaaaaatatttgttcaatttaacaagtgtttatggagttctgcctctgtgcaatgtgctaggcatgccgggggcacaactgtaggacacagttctctgtggagaggccttttgtggagtaggaagtggggagctacgatttattgtcaggcccagttcccagtgatttacttaatcctcctctacatatgagggatttgatattttctccwtttttgcagaggaggaaacaggctcaaaacaactaaacttgccagagctcacactcatgacaragtccagaagcaaatacatgttgtttaactccaaactctatattgggttcactaaagttagatttcccaagctagtgtyccacagaacaccactgtaccaaaagctattaatacatggtccatgaaaaaagccttctatgatcaaataagtttggggaatcagtgaaaactcagtttccccctcctctcacacctgagaatccacagagcacttttgcaacaytgcayattagcattttaaatactctgagaagtcccatagtaaagaaacctgctaactttgtttatcccaacattttctttccattttttgcaaaaactaatccatgtttgttatagaaaatacagataagctaaaaattaaaattatttatgccaccagcctttcagatttatttgtaggcagaaatagaaatgactgtgtattatttacaaaacagtgtcgtgatatacatacatatctttctatgttattccagcattttcaaaacatattttatcatggttttttcatgtttttacaaaacatgagctaacaactccctgagttctgttataggctgatatatagcttttatccatctaaaagctcaaatggaatctaaccatgtttaactttgctctgtaaatcaaacagaaagtatttcccttatgtgtatgtttatggcttcctctcyttccttagctcttcccagcttccacgtaagaattgtggaggaccagaggcccagggaaagccagggagaagccaaccactccagatatgtggagccaaccactccagtgtatatgtggggtgtgtgtgtgtgtgtgtgtgtgtgtgtgtgtragagagaggaaggagtgaggagagggattgatttttttctctggccaacttgggtgaaggaaatctaagaaatacatctttcagcagggcctagtattctcctcctccacttatatagctaccggagaagcaaaagtatgtgactagtagtttggaatactttggaattctgcttatctttctacttaatagtttgccagccatatgcttagaaaggtttgcatgatatgtttttttaatcaattaaaatgcataacatttcccctttcctaagtagaattgtccttaaatctcttcccttactattttttacttgcttttttttctgatttcattatttctcattaagtattgatgtgatcatgtcagagaagtgctcaatttcctatataccctacactgaatcacatagcatatataagaaatgtaaaccaaattactttgggattaagtgaaaaagggcctactcctctttaaacgcgggacttgagcagctcatgcctagcataaataggtgcttcgtagttctttgatgaatgacratgtgtgctgcattttcttctatgttattatttgcttatctatctgttcattcattcactaagtttatttataaatacatgaaagccttttttttcaattgagatgaaactaaaattagccattttaaagtgaacaattcagtgacacttagcacatacacagtgttgtrcagccaccacctctctctagttagagtgagaacctgttgcaaaacaaacaagcaaaaagccattttcatcattcccaaatgtgttcccattaagyggtcactcctagtcctcctccccacagccctgacaaccaccagtctgcattctggctcaatcaattgacctattctagatatttcatatacatggaatcatacaatatgtgaatttttctgtctggattctttcacttaatacatttttcgggttcatacatgttgtagcatgtatcagtattttattcccattttatggtcaagtaataatccattgtatgtatacaccacaatttgtttatctgttcaaatgttggacatttgggctgtttctgccttttggctatggtgaatgatgctgctatgaacacacatgtatgagtatttatttgagtacttgttttcagttcttttgagtatatacctaggagtggaattgctggatcatatgagaattctgtgtttaacttttcccctgcattaggcactcagaaaattaggaaggaagtaaagagtaggctctcccttccaaagagatcattgataatgtggtgcacactgaacatgctgagtgttgggttttagatgattttattagtgcaatatgaagcaaagtgtttcagtcatttacatggctgggcaggcattccgtgctctagagcattcataatgtagtttattctacctttgttatgcaggaagtgaagtgtacagtattacttgctctgttgtttctcatacatttaaacaagcactttgaacaccttgacagctgtttcatctcatcttacctactaattgtcttatataacggagttacctggggataggaacaactgttaagtttctctatttgactctctaagaagtaattatatatgtcttatgtattgtctttgctttcttttcagagatttatggagaatagcagcataattgcttgctataatgaactgattcaaatagaacatggggaagttcgctcccagttcaaattacggtatgtagcaaaatgatacagtaacatgaggttaacaattctttagaaaatcttatctgtcaacaggctgatgttcaggggttcatagctgaatcccagggattttgaagcttttaaacaggcaatgaatggcagctggccaacagcagtatctaarccagaaggcccattatataaagaaataaattggaagcatttcttcttttgacagyattttccactatttacagaattttaaaattgtaacctgggaaaatgcttaatttttgcacaattagatcgagattaggaatagccttgagaattattttctacttcctactttcaatatttatacatttttacttggattgttacgcataggggcaaactaatggcgatatttatcatgctaaccataaaaatggctaagtaaccacaatagcaattttattaagtctgtttgtggcctcaatatgcatgaagtagctttaagaaaccagttttaagtctctttacaagcatatagtgttttaagagcaggcttgtcattggtgctcaattccagggatgggattctctgcgtgtctggctgctggccagaatgctgggctgggggatgttctgctcctgggccctcttaggaatatcagggtcctagctcctgcctggttttgctcaggctccactctggcaggctttttggaccctgatgttttcctctcttctcagccagagagcagggaaaggaggaggctcttctccacccgtgggccactgcggggcccagtccccaggagcttcaggctgtgtgatgccagaaaattctgtagcatggcctctctctctggctgactgagaagtcatgcatagtttgaggctcaacacaaaataagtaggagagcatcctattatagtaattatatgccttatcttgattacttattgtcattcaaagacgacaaaatccttttcaaacttaattatcctccgtcccagggaggcaaaatgaatcgacataaacccagagaagcaggttcccctggggtgcaccctggtcagggaagtcactttttggtgggtagagtgatctaagaaataaagtgtggggataaacagtcactttcttaggtagaaaagtattaaraaaagaatctcaaaccagtgggaaatcagatattttgggacttcaggtatttttaacagcccttggtaagaaatattgccaaagactttttgagcgtataagtaagctagatcctgtggtttctttttatgtgtatgtcagcttcagagaacttcacagaatttttctagaaacccatgttgcctgtacttctgtaatttatgccttttaataatgtagattaattgttattattcctgggggtctctactgtttttaattgaaggttaaaagacttagtacttttattttagatgtttacacaataaatagaatyagaaagagggggattttactgtggtttaattcttcaactgtgtattacccacmataaaaaatgaacrgygcaacacctcattgcattgacaggcaattccattatttgattttaaataagtgcttctgkttttttaggcaacattacatgtgatggcatatgttaggtgccaggagatgccctaatacagattctgcagtgcacatggggcactggggggctgtcccaggaatgttaggggcaccttgtccatgatgagcagggcaaaagcaggcctggaaatttgaaataaatatccccagccaacacaatagcataaagaaaagccttcaggttattgtactgctgaaatctgttyagagccagggcaccaaagactttttaaggtcttatcmgattcagaactttgcaagtttctaagtacattatgtaagtactrtacttctgacccctcacttactagaactggttgggggcattggacccgttgttgaggtcataatgaaaaggctcaagttcttactacaaatcagtgtcaaattggataatggacttgacccasgaaggtagtggccccaggaaagaaggtttgcctggcacagrgattatcttgccttctgcacaagtttcagctgttgctttttggtgggttctgcctcaaccttattcaagttatcgcccttttgggtgtgtgtgtgaacatgtgcatgattttatgtgcatattcccaggtattctgtatctaggcccagcagataggggcagtgactcatgccacggcctctccccagctccttagggcactcagggacatctagcacatatacctgcaccccaaggcaggcaagcaactctatcatttgttgcagactgggaaaatgaggctctttattatacaatgctagaataattatagtctaattatataatactttcccctacaattccgcccccagctgcagctaaatatgtatcattactgtcattctgcaaggacagtctgtactgcaggatgatggtgaatgttaaaggtagacacctctgcctaggtcccatgtcaggtgaccatatttacttaaccgagaaacaaaaaggatcacctgatgtgatcaaacagaagatgtagtctaattttaagattctattatataaaataacttaaagatataagaactaaatcacatatctgtatgcctttgatgaattactctgttgaatagaagaatttatgaaatggagagcgtctaggataatctagattaaatgatgactatttatctcttctgatgttcttacacctctttatcatgaaaagatctattttatctaaaataaagataattatttagctacttagcaggagtttgggctgatcgatatatactaatgcagtaccagctattgtttgattcattagtcagtctagaagttacatccaagtcattatgtttatttcactccaaatcttaagacagtagcaatcctcaattttagaaagaatcaaaatttttggtgggcaaaactctgtattctgtggaacaccacatctctcagtattaacagacatttgtagagcactttattctcatatgggctctgcgtgatagccattgtgtttcaggggtggaaactgagctgtgaaggcttaaaatarccagtccctattgctttattgcccagtaatgagtgccamcaagtaacaaggtcacgatcctctcacctcttccactccctgctcccaactcatcccagactcctgctggtatgtggacttgtgttcagaatcttttccctacaagccaccgccttgcccagtcctacccttgttccaggcagcctcacagtgtgtgtgtgtgtgtgtgtgtgtgtgtgtgtgtgtgtgttgttttastggagtctagatagagcacttttggaagggacacaggagataatgtaacccaacaccctggccatgattgacagaggaaaacactgagaaccatcacagctactcagcatgttggtggcmgtggtggagtagaatccaggcatcctgctttttcagtctggtgcactttccactcagcatagcactatattatttatagactttatacctggacccctgtaatatttaccttttctctctggaccttcgagggctcttaagaaggtgcagggaaagtggtgatattacctatacttcatgggttcccacaactaggttacttttcccttgtgtttcttttttctagttttccaactttttaacctgaagaataaaacataaagatacctgagacaaaagagttatatggttcccaagaacagatattaataaagctaaggttcttctgccagaagagtatgaataattaatacaagcaattaagttctaaaactctagaaacatgactcaagttgattatctcattttgctgcaggtttatttaaatagaaccatcaaccaaagaggttgagagcctgaataaacgttgtggtctggtagtgtttgttgtggggggcaggggtgggaaatagtgtgttctttctaccaatatcctttcatttcaactgttgataagcatttactttgtcttatggggctttatacttattgaaaatttcatgctttgtggataatcataaaatgaatgtttaataaattttggagattggatctaagatcatgtataaaggcaacctcttgaattgatgaaaatgataatagtctgaagtacctgtttatatacttagttgaaacctgtttacatagttagagaaaatacttaggcaagagaggaatttgtcatttgataaaatgtgttaattaaagcttaattatccagctctcaaaattaacaaattagtccacatagagtgtgtttctccaagagtgacttctgaaagacagctgctgcccaggaaatccttccctacagtgcttcgtccagttttggaccaggtgcctggaaaacactgttgataagactagctcttgctgtctcttatgaggcagtgcagtgacaaatttggtagcagttttaaagcccccttttattcttgtttcttattttaaattgtgtttacaagtggtggtactaagacagtatacagttcaaattaggtagactggagcaatttaaataagaaaatatactactgcgcctgtaagccatttcagttgrgttaggttaatattctcctctgctcttctaacccgtatcatgattacttgttacacttaccttctcacactgatatcttcatttctgcaactataggaatggcgtcytgcagttggctaaaatattgcactccgcacgcatacctcactattattgaatacagttcttggtttgacatttcaggtatacttatgagaaaagataggttacgattcatttttttcaccaaagccttttgaaagccttagagaacaaagaagtattactctgtgatcttaaacataacaacaggtawctacatgtgttgtattctcatattgtcccaagcacttcgagaaatgcctcacataaactatctgttttgatctttacaaaaacctgtgaaatacgtattattatcctcattttatggatgaggaaactgagggccattgaagacaaaaagttgcctcaggtcgcataactggaaaaatacagagccagatttcacccagttctttctgccttcttccctctaaacggatcaaaataggaagacaaagttagaatgcctttatgagtggaaaaaaataacatttttcagagtttttttttttaaagaaaaaacatcaatccagtaaatcaacagtttttttttattttgtaatgtgtaagaaagctttttattgggattctttaaacagtcagtataaataacagagctctagctacatgcttgctgtgttggacagtaaatagcttactgtatttggagttgctctagattaggaaattagttaaaactatgataaacaaaatgagagtttgattccaaatattccagaaatatagggaaggtcaccaagaaaagtccccactggagagctgcagaggtgcartgaaccagcaaggggagttctgctgggtttgcctttcaccatgccagggggaatggttggaagccgagtaacatcacaacagcaaaaaaggagaaaaaatgtttttgtgtctgttgcaaaaggccagaatacctcacatccaatttgggcccagttaagttctctaattgttggagacttaacttctccatgaccacaactgtgaatgaaacagaagaacgtcattgcctcgtgttagtgttgaagtttcattcagcacacacatagtccattccatgatccacraagatttcactgaattacarttctttttgtatcatacacacagatatatatgctattgtttatgcatttagtttgaaagattagtttttttccctcaaagcatattattaaccctcttagtctgttaggattgcaataatgaaatacagtcatgcatcatttaatgatggggatatgttctgagaaatgtgtcgttggatgattttgtcattgtgcaaacatcatagagtgtacttacacaagcctacgtgktatagcttactacacacttaggctacgtggtacagcctgttgctcctaggctacaaacctgtagagcatgttactrtactgaatactgtaaatacttttaacacaatggcatttgtgaatttaaacatagaaaggcacagtaaaaatgcagtataaaaagakttaaaatggtgcacttgtataaggcacttagcatgaatggagcttgcaggactgggagttgctctgggtgagctggtgagtgaatggagagggaacatgaaggcccagggcattatgtgtataggactatagactttatcagctttgtactcttaggctacacaaaattcattaaaacattttcctttcttcaatagtaaattagccttagcttactgctactttttaactttataaacctttatatttttaaactttttcactttcttaataacatttagcttaaaacacaaacacatttcacagctgtacaaaaaaaatgtttctttataacattattctgttagcttttttctatttttaaatctttttttttttttttttttactttttcaacttttttgttaaaaactaagacaaactttggctggtgcctacacagagtcaggatcatcaatatcactgacttccccctccacatcttgtcccactggaaggtcctcaggggcaataacacacatggagctgtcaccttctatgataacaatgccttcttctgggatacctcctgaaggacctgcctgaggctgctttacagttaacttttcttagtagtagaaggaatattttatctaaaacaatgataaatagtatagcaaatacataaaccagtatcctagttatatcttatcaaatgttatatactgtacatcattactgtattgctacacatttatacagctgatagtttagtgggcttgtttacaccaacatcatcacggacacgtgagggtgttatgtctgctacgacaccactaggcaataggaattaggttataatctcgcaggaccaccattgtatattgagtccattgttgaaatatygttatgagttgcattactgtatcttaaawtgagtaatttataagcaacagaaatgtattgctgacagttctggaggctgagaagtccaagatcaaggtgccagcaggttctgtgtctggtgagggcctgttcctcatagatggcaccctctctatgtcctcacatggcagaaagtgcaagggagctcactggagcctctttaataaaggcattaatcccattcatgaggatgaagccccactgacttagccacttcccaaaggccctgcctcttcatactatcacattggatgttagattccaacatatgaactgttgggagacatcagcattcagaccatggcaataacaaaaagtacgtagatttgatgaacctggtatctgtttactttgttaaattaacagatgaaatgtgaatggttttcatagaagaactaacttcaatcttttataactttcagggcctgtaattcagtgtttacagcattagatcactgtcatgaagccatagaaataacaagcgatgaccacgtgattcaggtatggaaagaaaccacctctatcattaacattcaaaatgaacctttcaggtttaagccacactttttatcaagtactttcccatcatsctcatgtatcagcacattttcttaggagaaataaatatcaagctgtgcaaagaatactgatagacttaagaattagatattcaataaagaacaaaaaattattacttcagatcagaacctgcaatttctttgacagaaatggggtttaaaaaaattttatttttttgagacagattgtcactctgtcgcccaggctgkagtacagaggtaatcttggctcagtataatttctgcctctcaggttcaagtgattcttgtgcctctaagtagcgaggattacaggcatgtgccaccacactcagctaatttttatatttttagtagagattgggttttaccatgttggccaggctggtctcaaactcctgacctcaagtgatccacctgccttggcctcccaaagtgctgggattacaggtatgagtcactgcacccagctagaaccggggtaaattcttttgaccatctgtgaagacactattgacatagaagtaagtcagaatggtacagcaaatgcttataaatgtctagggaacagagtattttcaaagacattcatttgtttacctgcagtgggtatcctaattacaaagcattcttacatgaatgtcatcctcctaaggaaatgtgtgtagcagagaaacctttcaagaaatgaggtgttcttattataattgttggaaagtaagacatctgtatttgtaaaataccctgaaatatagactttccacgaattggtgcttgcctgcctgctgttggtttgcagagtggcatggagtgtgaggagcacttatcagtagggcaccaaagacagtgggcaacacacagcgaagcccacagcagaagcctcacatttgtctgccctgaaatctcccagtgcacacatacacaccttgttctmataccagaccaatgacatcaayagcccaccctgcctaggccctgtcatcagcactttcattaggttgtctcatttctattcaataagggtaggcaagagacatcattgccctatagtgcagatgaggaaactgagtcccaacaaggccaaggaacttatccaaggaaagccttagtaataagtatcagaactaaaatatgtagtcatgtctccaaagccttcctacctggtttcctgtttagctgtattgttagaatatgttttatggctgccccgtgaaatgyatctgaaggcttcctcatgwtgctggctcttagtggcccacctgcccacaggtctgcctcttsgacctcagagagagccagacgtgtttctgttacagaccaagcacaaaaatcccacatctcccccacttataccccgacttggacaatcgattctattcatgaagcacatttgctttgcacctccctgttttgcagtgtgcagctggatttgatttcagaaatgaggagaaggggctccctgcccactagcygcccctccacctgtaatctaacaaacracttctagaatagggaacagagtctttcattctccagttatcaattggtggttagaaaacctgtatccttgggagaggtaatattgtgatggtgtcacattatgatattaatcatctcccagcctttgygatgaacaggaagaagcaggagcatgaggccagtataacagatgcctgtaaaggagaggtggaaggagagtcactgcctttaaagggaaacttggattctgaaagaagaccttacagcttttttctcagggaaccttttcatcctcctttagaaaaatgtatcagcaatctgtagtatggaacttaaaacaagaggaaggaggaaggagctgaatagaggatgttatatgtatggtgaaattacctatgtgctataaattttgaggatgtcatcattggatgggatagttaatatatgttcttacttgatatcagcatccttttcagggcactccaatcaaatagttagatgcctttttgaatacaaatcttcagaggtcaagtagcagcacttaaaatttagaagcaatatctacctatctgtgtctgtctatccatctgttatctatccacccatccattcctccctcctttccttcctgtcttcctccatgcccccatctatctaaactctatatgtatttgctttaaaacacttaattgttacttgccatatactaggctcagttctaagcatttcacacatactcatttatttcttaaagcaatcctgtgagtcaggtatcactattgtactcattttgcagatgaggaaactgaggaccagggaagttaagtaatttgtccatggttctgtagctggtaattggcagagccaggatttgaacttgggtgccttggctccagaatccatatctgggagtacctgctgcattctgaggtttcaggaaccctggtgtgaaagaagggccatgacttctacccaaatttacaacttaatagggaaggcagaatgaacacacatgaaaaggtatgagaatatggctaacaaataaagaaaataatatattctctaatattttctattcattcctcaaatagttaataaacagtcctgagtatccaaagatcaattcaaaatagcctttgcccttgaggagttgaatgtccactgggagagacagagataaacaaaaatttaaattcggtgtaataagtcactgaaagtctgcacaggcatcagtggcagctcttgggagtggactaggtaggggaatcagggaaggcttcctggaagagaagagggataaattggagttggagagggaaagagacagggaagggtattataagcagagagagcacgtggggaaaggcccggagatgagagagacatgcagacagctcagcagcctgcagaggtggccccgggaggtatgaggctggctttgtgagcaggggctacgctgtaagtgatgcccttccctgcctagggagggccctgagtactacatgtcagtaatggggccaggagggggtctggagatccatgaagacaatatcaggcctccttctcttcagtcacccaccaaaggcctgatgaccagagcatcttccaaaccccttcaactctcagggttgatcgtgttaatagaagctgtgtctcccaaggaacagctccccaagtgtccctgtgccaccctgttcatgactgctgccatcacagttgagggcaagagtgattacagttggttcgaacatctccgaagcagcagatggatgcaatttaagcccaaagaaattcatgacccagatgcagtctgtttacattttcccgacattcttcaccgcttgtctctctccactcagcccccatctgtgatctttgaaaagaaatcagagggtgggacaggacctgggagtcatctagggtcatggctctaaattccaggaccccaggcagaattttgaaaagaaacctctgagtctgctggccccagaatctgccgaggggagcttcacacctgcctgagcccagcactgaaagggctgcctcctgccccagccatttaactgaatttattgttctgattctactggtagtgtccccaaactrtagcaaacattgatcaatagatagtggcaattggaaaggagacatgagaaatccagttgtggagatgtgcataatacaagccgccactgttgaatggagttcttatttgttcrtttgtttgtttataagagacagggtcttgctgtgttgcctgggctggagtgcaacggtgcaatcatagctcactgcagcctgaaactcccaggctccagtgatccttctgcctcagcctcmtgaatagcagggactacaggtgtgtgccacaacaactggctaatttttttatttttgtggaggtggagtctagctgtgttttccaggctggtcttgaactcttgggcccaactgatcctcctgcctcagcttcccaaagggctggaattgaattacaggcatgagccactgtgcccagcctgaaactttctttttttaactacaaacatatggacccagtcctaatttatttttatttctttttttgtctgagtttttccttattcatggggcggtagatggtgaatgagttccccaagaggctggtactgctagatgagggcttcctgtktttttcctgctgaagtttcttctgatatcctacaggggatcaggatggcagttgaatgaataaattgctgccaggaaggagggaactcctccaggaagggtttggggatggaaaggggcagcaggacctggccagctaactgcattagagaatgtttgccctgggaacttcttgcttgatattcctctgggtcccaacaagtcttcctacggggcacacagacatttcatgaattctgtcttgtgtccccgcactgatctgtaccaacctcccattaacagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggtgggttacaccagcaaaaccaatccaygaaccctctccccaatgcacttttttttctgagttttagaatttcatccttaagattagcttttttaataatgtcataattaagtgaaagatctattatgtttgcaaaatgagttcrtttttaagttaactttggaactcaagtgaatctggtgcttatcattatggtacagaatctggtgattttgtgtgaaaacatttcatcctgtgcatgaatatgtcccatctgccattgctggaatatcgtgggtatctctgagcagagttccacccagagagctgttgtgttttttcagtttatccagtgtttgggagactagacatatttaataccagtatttataggtaggccaggtttttttcccagttttccttttctgttctctgatcrctgttcaacatacatttgtagcttcctcctcccagctgcacctgttcctccagtggcttccccttcatctgggtagatgaaggtaatgatggaagtccgagaggaattttccctgaagccctctcctcctgtagagcactgcctctcatcgctggaactgcctgtgcattttctgttaagcattcagaatgcttcttcacatacaatttctttcatcttcctttctgtgatgtgaagtagttaaataagccctgtatccatttaatagagggaacattttagagggataagataaatttggattatagatgatgatcaaaatgtttttttaattgaggcaatgagaccaaaaaggaaacaagacattgttaactattccaaagattgttgccaaaagaatatagccacacataccaaggtgcataccaattagccaccttatgtgatagaggggacaagaaatggctgcagggaatcggaatctcagtttctgattagccaaacctcccatgttcagagaacaggaaccratactctccccttggcctctttcacggaagctaagaggagccagagtaacccccgagaagccttggctggggggcccgtaggatgttaggaagatgatgggcttcagcgagtgttaagtagacatgaatttatacgcagattttctgcatcctcatgtgggcaagttacctagactctctgagcctcagtttacccacctgtaaatttagtatgataatgccaagttcacagattgctgtgaagattttgagagagacctccaaagaatcccttgacctggtgccacagcagccatagggctgagagcagaattccacccacaggtcaagtgtcctggaagctgggacagacaacctggtggtggatatgtggatctgtggtcttgttttcacacatgtggccacatcagcattgcactgggtacaacaatacagcaggcattgggaaatgtaacgagagcatgtgggaatrttccttctcagccttctgagaccctctgcaggagcagctgtcatccttgactgaaggattttaagagctctctttgtccatgtaggagtggcagggggtttactatgccagacggaaatccggggacagcatccaacagcacgtgaagatcaccccagtgattggccaaggagggtgagagcaaactgttcaactcttttagctgragataaagactcaaggccctcatgggcattgggcttgaaatgccagtatgagccttacatccacaaatgcagtagggttgtgctgaatgtagtatagatcgagggtgcttccactcagccggcagcaacccccaaacatggttttccatgtcttttatgaagcatcaccccaacctcccacctccacctgatcacctatgccttctgtcattcccagtgtgctctaaaggggcttgatttctgggcttccctttccccataacaacaatgatctcctgctggtgctctctggcctctgcactcagtgcatagggagccaaccttttctcctgcttgaggccctcgctccatgctggttcctccaggccggttctggacttgttccttggaggcccactgtttatggagagaaaggtgtgtctgaccaggagctgagggcatctcaatccactgaatctcagattaccagagaagcttctctcttttgtggagagataagaaaaatatgcaattcctcttccttcctccagttaaattttgtgagatttacaaagccaaacaggaccccctaaccatacatcatggtragccgtggggagccagcctgaaggtcaacaccaggttcatagcttgggtgtataaggaacacracgttgtgtgacatgtcagaaaaagatgaggccacagtcwtcctgccagkaactggaacaggagccccacctgtgactcttaggactacctgagttccttgcaaattgttgtatgaatagaaaacgagatgtttcataaaatcagccaggtatttgtaatagcttgtttcccctccaattttggttagtttcaaaattgctctcccatcaattcaggctacgtcccgtcaataccacctggtatttcatgccattttgtaatttgaagctccctttttgcttcactctggatgatgggggcactgacaggcccctgaccgaggttgtgagctggagagaggctgcccctcggccctcctcctgagcagcctggcckcagcgtggccattctcacccacaggcagtgctgagaactgtggggtggagatgatgcccgtgactgtcacattgtttttatcctcatccttataccatctcctcagaaaatcaaagctaagaatccctttctgtgtgtgtgaccagaatcattaggcaaccaaagcagaggagacatgctattgcctggtaatttccaacagaatacacttttctggtctctctgattttacagataagaaaaagaagttcttttgtccagacacaatttccagtgttattttccctgtaattgtaggcagtgagctatcagagrcaattcttattaaaagtagggaaattttacctcttcctagttgggtgaagtttattacagagtaaccagtattttatatcctcttttcagaggcctacagagaaaagtgaaccaggtaaagagagagagagagtgggataccccacgggcttctgggggcaaaaaacctaatgtaactctctggatttcatggttttactctcagtaaaatattgactgtgagctgatttttgcatggggctgaggcacctgtcatcttttgcccggttttccttgtgacagtgataaagagtgaggctgcccactgagtttcaggacccagtccatgacgttgaaatgagaggatttttatctgcctgagaagtgccattattatgacaattatagtgtgaaagaatatgggatatttaatataaaaacagcagccatgaaatgtggtcattgtccaaatgaatcttttgtagctatgcaattattagtatcagcagaattaaaactaatttatttgtagcagcattttatcctatcaactgaagatatctaggaaccaaactttaggagtcagttacaaaataacatacccattagggaagtgtttctgagccctctaggatgtataaaggaggcccagtttccaaaggcatgtgtgggctctgtgtgaaaactgtgttttctgtagattgagtcttgcttgaattttaaaactgccctaggacgaaccctggagtttagctttaagaagtctgttgacatttttatttgctgatttgttgaatcatctcatatctgactcactaataactgattatttgttattaggaaaattaggcattttgtctcgctcaagaaactgtgttgtaccactgacaataataagcaggtatggtattagctcacttcgtttgctctgtctgtttggccatgcgtcacctctgttctctgcttatctcaccactgttctctgcttgtctttctccatgtctaattgtagctgccaattaagcagatttatgggaaaatktggttcctctgacaaatctttttatttcccagcaaacctatatcactttatttgtagtgcacatcrgttatgatttagcttgtggctgaggawctctctagactaatatatgaaggcataaaatttttcctccaaataaaaaatgttctatttttatcttaatttcttaatcagttggaaagtatatatccatttgagcattgcacccctacaaattcatatcaaaaacaagaatcattccaaattagtactgcaattttttcttacccttacatcatacagaagaatacatctggatgttatcatctgcagtaacagaattttaagaagccactttatttaagaactttttaaggtaattttgtaatggagggcaacattggtgtaggtattttttctatttgattagtacttttactactggattatgtgtattttcacttcatgcattgtaatttgtagattaacaattatacaacaaacataattatcagtgatctatttttgaaaacttacaacatgtggtctttgatttttatgaggattttaaagagggacagtatctctaaaggatttcaagggcttctgtggcataatccattttagtagaggatggcagagatgtgtgaagtgctggatgagaaggtgaagcccagccaggcctggagatcaactggaaccagcaggacgtgagtagacagtggggtgagcccagtgagcccgtgagggtcttcagtcggttgtctcaggatatcaaaggggtccacgtccatgtgctcctttataagatatagttggagataaagtccttcctccagcactgagaatctcatctgaaatcaggatgttttcacataataccatgaagtcatgcaagaggcaagtccttggagacctctggtaaaggaaagaatggcctttcatagggaaaaaaaagggttccaacagacattttgctacataccaggagaaagaatgagttcttcataagagctgacgcaggcagaaagagagggacaggacacctggtgtctctttcgagacaaacttctgaacacaagcagtgcagaccaacatttcttggctgtggatccacagtagaggacacaggtccactggggttcattcattctcatgccagaaattgaccaagcacagttcatgtccagttcatgcctttcccccaccaactcagccttgctcctcttccttaccttctttctcacttaatgacagggacccctactctccctgtcaccagtctccctgcaactccatgtgcccaagtcctaccagtccttcatgacccagtgcaagaaacattaagtatcaccttctttctgaaggcccctgaggtaccctctttgctttgtatcacccaccaaccaccgccatcatcttcacagctatttgcgtgctaaactgccctctcccctctagcagggccactggtctgtgctgtccttgtgtgcccacactgcctggcatgtagtaggccctcaagctggtggctagcgttaatgaaactgaatgtctcagtcctggcctcctgccagctgtaaagccctcctgcctcacagggagagcaggcaagcccttagcacaggactttaggatacaggggtggggggccacctgctttttttctgaggctctaagtagaaacgcctttactaccatgaattagctgctgctcctagaaaagaggaaatgcagagctcggataccctgagccattgacgtcacctaatggtactgcacaggcctggagagacatttagattttctaataacaaagcatttttatacctctggctaactacagtgtttttcctcttcatcgaaggaggctgcagcgaatggcaatgggatctgtgctggggagggcayctgtctgcaggcggttccggtggtgtggttttctggggtttagccctgatgtcaaaatcggcccatgggtttgcattttaacaaggtgtgacgtggtaagccaggctgctctctcctggtaaggcttgccgtcagcaaagatcccttttcctgtatgagccctgtagctttttgccaagaggctggaaatgctcagtgaggtttgtctgttgtcttcctctcctctgcacacacactttctccccaaatatgtgttaaacacctgttctgtgctggcaccagggacacaatgcatctgcccccaatgtcagggaggccacagacaggtaaacagaataaatagaatgcagcacagaggaaatgtgaatcaagcactggagragctcaaaacccaggacctaaggaggctgtctgggatttttagctattgtgtaaaataggggccaagaaactagagcctgcaggccaaatatggcctgttctgtaaataaagttttattggaacacagccacactctctagtgtgttgcacctctggctgctttcatactgtggtggcagagctgaggccatgtggcctgcagagcttaaatatttaccctctggtcctgcacagaaaaaggttgctgacttcatttcttgaagataattttctttcttggatgttccattttcttaggccagcaacagtctgccctgacctcccagaagtaccccttctccccttcatacacttctttgggcaccttttgccttcgtgctagcctctgcgtcctgtctcaaagcctatctcagcccctgcatactggtgcggacacgagaacctaggtcccctgaggctttttccttttcacaaggacaaaatccaaatgcaaattcatggctcaracttcagaatttcaaggatctgcaaccatggtccaagagtcatattgcatagggaaaaaaggaggcagttagggccctgacattatatctgctcttgtgtcttgttttgttttgttttgtttgagacagagtctcactctgttgcccaggctggaatgcagtggcacgatctcagctcactgcaacctccgcctcctgggttcaagtgattctcctgcctcagcctcccaagtaactgggattataggtttgcgccacagtgcctggctaatttttgtattttttgtggagatagggtttcaccatgttggccaggctggtcttgaactcctgacctcaggtgatccacctgcctcagcctcccgaagtgctgggattacaggtgtgagccaacacacccagccatcagctcttattcttgttacatttttaatgtggctactagaagttttaaattacacatgtggtttgcatgtgtggctcacacaatatttttattggacagacctggtctggactttccctmccctgccaaatcctatcacagattcacctcacttgcccttttgcaggtgacgggatgctaatgagctacagacttcctctcgtttctagcaatgagtcagctccagactcactgagcctccaggaaaagatastgtaaccagtttcccaggcccctaggaggcttttaccctcactagaggacattctgatgggtgcttaagcaaacctatagagaatgtctttgcggggagatgcagggcccctttcaatcattctcaaactgctgcagaaagttaggtctcactttctagagcttggtggacagtggggagtaccatgtcctactgagtgtactcaggcaaggggacaccacagccctcagaaaactaagcagaagtgggatgcatgggagccagtgagggccagtggacagttaggcacagtcatcatccctgcttgtctgggcagcaaagtggggatggcttattctcaaagagaccacacatgcttagaaaccctttagccatgggttgagatgggtttcccaaccatgggttaaaggagatggtcagcctcccctaattaaaatgacctcctgcccttttgtgggaacagagcaaagctaccagttgacagctagtaarattttttttcctggcacagcctggcttcaccagcatgtcacagaggagactgccccacagttctcaccaggatctaggagcttctctmcaaacccagcaggtcctggatcatgggccttgtctgagatgtgtgcggtctgagtgtgaccaacaggctgctccaccaagcaccgttggtcgatttcttttttgcctcgtaggactgtgctcacagccccctgaacccacaaggacccaaggactcaaggactctgtagttgcttgtgcccagtactacaggaaagaggcaggctgacgccatctttcttttcttcctccctcttttgccttctctcttttatccacactctaccttcagtcaccttctgtaggcctccagacagtccacagattttcccatccagtccttacaccttcatggaccatcctctcaatgggtttctgctgcctrcaacccttggtggcccattctggttcccaccgccaggccagccttctcttgggtgtgtccttggccttcactgcccccatgcctttactctccccacatttgcccatttctgtttctctcatcccttacctttctaggggtggtgtggccgatgggccttctcatgatttggggccttctcctccagcttctggcaaaccatgatccttagcactaacagagtctaatatctcatggcattctcagcagaactgagagaagagggtggtgggggttctgttcattgctaagtagtgataaaaacaaaatttcaatttgtcctaaattcccagtacttggctcttttacatgcttttaaatagtgtggaccttttgttgcttccctgtcctttaggactcaactcagcttctcttccccccaggaaatcttccaaaccttccagcccatgtctctaccctgcaaagagggagcagggacactttttgtctgcaccacccattggatcattaatcttatgctgctttgggtgagttctcgccttagggcggggactgtgggttatgcctcttcgtacttcctcctatgtatgccccatagacatcaggaaattattttgaaaactagtttttactccttaacacaataacctttggatggcataggaaattaaagatgcaacttctgtcttatcccgaattcttattccatgtagagttgatctatatgtagccaatatatgtctcacatggtgttacaaagaatagtttctgtactcttccaaggcacacatccaagtgtgacttctttttttaaaaattggagaaaaaggctactgcaactgaaaacatgactgcagttatctctaaaagcagctagtcacagaaatgtattttatgtaattggaatattactatgatacagactttgtacacgtgcaccttatttgtgtgccccaaaatatttattgacatatttggtaaagccacaaggtaaacaaaattatccaaatttttccatttagctttagtacgtatttacaagaatctatttaaagaaaggcctctgatattgcgaaaccacatttttttttcctgagaaaccacgtttggaacagccaacccccgagcagacatgaatggaatacctgctacacatcagggactgtgggaggctctgagggcacaagataagcaggggcttgcagccgggaggaggggacaggggtgggggtactgagaatccaggggtaggattctgtgtttgagaagtcttgacttagaggagggagagacaacttcacgcttggtggtgatggtggctgctggaggtgatcatgccaggctctgtgaagttccagagcatctgaagctgagagggggctctcttggcttgcgagggaaagggtaaaccgataacattctgggcatgtgcacctaccctgagcatgatgtgagaggaggctgcctagtttcaggtagacacaggtgccctttgccctggcagagaagsttaccctcatggccygcaggacagcaggctggggggtgtctgccctgcacggatggggttttttgacccgtctgttctctcattctatcctttctgctacatcaaggatgtttataaggcaatggatgtttgtttataaggtatccctatggtggggataagtgggaggtggagaatgggaaaatcagagggaaagaagctataggtctgagctggaaataaagtgtctccttgtgtgagaccagtaatgcctgctcaccagtaataaccagcttcagcagggacccccaccaccccacctcacccttagctgagcctcagtcctggaggcctaaacatagagaaaaaataatttgacttaagaaaagtaagatagactgccgggcgcggtggttcacgcctataatcccagcacttagggaggccaaggcaggcagatcacgaggtcaggagtttgagaccagcctgaccaacatggtgaaaccccgtctctacgaaaaatacaaaaattagccaggcgtggtgcacctgtaatcccagctacttgggaggctgaggcaggagaattgcttaaatccaggaggtggaggttgtagcaagccaagatcatgccgctgcactccagcctgggtgacacagcgagacttcatcgcaaaaaaaaaaaaaagaaagaaaagtaagataggtttggtaatggataatgaacagacatagctgagctatttcttaaaaattaatgttatctattcatctctaatgcattgaagaccactaggatttaaagaggagtattatgttggcgtttgggaggagggttttttcccgataagtttaactaaaattccaaagkttgcacttctacatgacttgtgtcattcagactattacaagattctgctcactcyggaggcttgtactaattaagcccaagagacttacagtaccttaggcctgacttctgttaaagttttacttaatataccaatttttaggccacttatgggtgttagcactctatggaaaattttctttttccaaagcaacagttggtggctgacttttcagaaggaattattcacctcacatgaaggaatcagtttctggcattttgctcaacctaaatcatccattcagtgagcatgcatgcctgctggcacttggcccagtggaagatacaggatggatgagactgaagtcactccttgcatctgctcttgctagaatagaatccctggcttggctaatgagacccccatttacccagtcacccccatcctaacctgggaaccacctttagcatccttgctttcctgagccccctgcatcctagaagccacttagttccaaaggtgatgtctttgaaacaactcttgactccatgcccacttcccaacccaccaccacttcctttaagccattrtgacctctcatcctacagagcctcatgaccactccctctgcctccttgtaatgtgtgctggagccagttcatactgacttgtgagaactgattgtttaattttctggtattttgtgatttagtgttaaaccagccattattaaaaattaaattatataagcatgcatttaagcaaattttatttgtaagaagtaataagtacttacattccatcccttcccaagcacataactatattttactatcatgtgtgctcttgacatttgtacgtctgttttatctgtattatggaaatgccagataaagctgtgccctgcacacatcttcccaactccacattcagtgacatcattctggcagctttaaacagccatgaagggagtatttttagatcaagaaaattggcaaactctacaaatcaggacctttttttaattgatttttctagacttaaaaaaatgatgaagaaaatgttaataatacaagataaacttaaatgtgtatcatgtctatagtagtttcattgtgaataacccaaaaatatcaagaatgattcccccagtatttacaaactattatttgattcaacaaagaagttcctcacatcactgacaaatgagtgaaatttctatgtacayctttgttatttgtctttcatcttacttttttttttttttttgacatggagtctcgctctattgcccaggctagagtgcagtggcgcgatctcggctcactgcaagctccgcctcccaggttcacgccattctcccgcctcagcctcccaagtagctgggactacaggcrcccgctacctcacccagctaattttttgtatttttagtagagatagggtttcactatgttggccaggatggtctcgatctcctgaccttgtgatccacccgcctcggcctcctaaagtgctgggattacaggcttgagccactgtgcctggccctcatcttactttttgatgtaagtgaaaatatcaactaacatttatgccaagactccactcattcattaactgtaaccataaattggctgctgatacaagaggtcaaaaaaaccagcaaaagcattttgtgggaatccattggctatatagactctacaaccaagagtgccttatatttgaatattgttttgaaattgtgtgttatacattctttgtattagggattgggaaatttatttcttaaagggccagatagtaaacattaggccttatggtctctgtcaaactgcttaactcaactctgccattgtaatgggaaagcagcaatagatgatatataaatgatgggcaaggctatgttctaatgaaattgtatttacagaaacaggtggccagtacatactgacttgygaaaactgattgtttgattttctggaattttgtgattcagttgttaaaccagccattattaaaaattaaattacataaacatgcaattaaacaaatgctatgtttaagaaataataagaacagcccatcccttcccaagcacattactatagttcactatcgtgttagtaatgtcaagagcatacatgatggtaagctatagtaatgtgctatgtggccatatgctaaattatggcctggaccgtaatttcctgacctccgctttatatcagtaaaatgtrtaataaacttatgttcggctatctttgctttttcagcaagctggtggttaaactcttagcagcatactgttgactactatcctatctggtccccagtcctcattgtgaagggctcagtggtggttcctcatcactgactaaaccatcatcaggcatctttgaggagcacgctcctgacttcctgccccgctttccctgccaccttcccaagtcacactaggctgtttgtagttctctggacatgccaggcttggccatgcctctgtgtgtcactccctctgtctagcatgctcttccttcctcctgtcctcctggaaaaatcttggtcccctgagccaggtcaggagccccctctgtgactgcccccggccacctctctcctcctccccgctgtggagtggatttggcactgaccacactatcactgctcagcctgaccagaccctccagggcagcatcatgtcttggtcgctgtgtccccatctcccactgatgctgctgaatgcacttagtaaagatttgatcagtggagctcatggaagagcctatgttttagtaatccaagtaagatgtctttcgtgttgacactttgtatctgttactctccaagtgcatttcatacattaactcctgcaatccttaccacaactccaggagggagatactaggctcccctttctacagatgaggaaactgaggcttgaagtggtcaagaagcctgtccaggcttcacatgggatgcgtgtggcagaaccaggattctaaccctaaagtagttagcaatatggaaataaaggaagcacaagtgtatcttcggagaattcataagagaaaggtttcccttgcttgggaagtgaggggatgacttcatagaggaggtgttgactgacgtgggtttgagcagtggatagaatatgtcattgtaggcctggtgcggtggcttatgtctgtaatcccagcactttgggaggccgaggtgggcggatcacgaggtcaggagttcgagaccagtctggccaacatggtgaaaacccatctctactaaaaatacaaaaagtagctgggcatggtggcgggtgcctgtaatcccagcttctcagaaggctgaggcaggagactcacttgaatccaggaggcggaggttgccgtgagccgagatcccaccattacactccagcctgggtgacagagcaagactccatcgcagaaaaaaaaaaaaaaaagaatatgtcattgtagggagagatcctctgcaaaagtgaaaaggcaacgaaaggcaggagaggagataatcaagcatggctggtcccctcaatgtgtagagtaggggagcttgagctgagggtacagttggtgcccagatgctcagctgcccacctggcttggcctggcttcctccacagtccataccctacctccaggtgcttcagggtccacagccaccccagtgggtgtttgggctgaagtagatcatgtcatgtggatgggcctgtttacgtgatgtgccatggaagggagtggcaggtgggcagcttggagtgaaaagctaagagagtgaggtagctaactgcatctgtacggagaatcctgggtctcttttatggaaaactggaggcccagacctgcgtagctccttgaaggccatgagagcacctcgtccaggagtgggcaaggttgggcatgcagtaatgtaaatggagtagtaaatgtcagctctgactgcagcatttcagttcagctttctaccacactttggaggtatgcagccaactgcacctaaaacccagccattgtaccacctgcttctttgtctataggaccctttatttctaacatggtcaaagcagtgttcatcacataagattagactcaagcgtctggatcttcgcttctgtggtgcctcatttaaataatttctaagaacaaaattccaagaggtatggtttcctctagtgccattgcttgaaaaagaagtgaggaggaggaagaatttgaagtgttcttccttccgcttctcaccctggtttgctgaaggctaggtttcctgggtgagatttcagagcccagctccaggaaactgaagaaagtatgcatttactcatcctgaccagctgcacctaaacccagaatcaccatgtaaggagtggcttcaacttttcctcattatttgttagtcaaacaagatggctgcaggatgggaggctgaacagctgcaacgtatgtactcgagggtctggggaggaagaaaagggccaggtctcagtgggtgccattagttctgcaagtgccttttgagcactttcatagcaaacacaaccctgaactatggcacgatgaagagaaagcacgggggagcctgctctcaagctgctttgggtctagtagaggtttgtgagaaggtttcagatcactggaactgttgaaaagagtttaagtctattcgcagagctttggcccacaagttacaaaggaaacaaaaggcagattcataagaagccagttgtaatccatagggaacactggacctgtctgatggcggaaatccctacaggaggaacgttcacatctacccactggtgctagggaacagcagctccttcagcacctgtgttcgatgaggaggagtgtggaagggctaacatagtggctcccaaccttggctgcacattggaatcacctggagaattatcaaagaaaacaacaacaacaaaaacagaggctctgatagattgggtctggggtgcagtctgggcatgaggatttctgagagcgccccaggggattctgatgtactgctgagggtgagaaccaccaaatttctgagtgaattagatctggcgcgatcatgttatattaggctagggagctttcctgctggatgtcttggagggggacaagactgatttgaccaaaaactcctgttagggcaggctgatagaaggatggcctttgtataattctcacaaggaagaccaggccactgtggaactgccaggggtagggaccatgccttcatcgtcrtcatcttatatctgtctcctaggtcctggcacacagaaaatatctattgaataaatacttgcatccaggcagagagaagccatggtgtttgggtagcagcagtggtttctgagagacaggggcctgtgtgtgcccttcctcaggctttgtcagggccagggagcttggagcatagcttgggcttccagagcagccagtggcccaagagaagtctgacctgggcaaagctgctctcctctctggactcagagagcactgtgatgatgtggctctscctgtcttgtcagccatgtttccagcacttagcatgaagcctggtgcacaggaggtgcttccgtaggggtagatgatgtgctgggcagtcagccctcttcctggaactggcttcaggcaccgaagctcctctatctgcagggcctgacctgaaggcactttacttcctgattacagtgagatttggggacaaatacaacaaaaattcattccacagtctacaccccaagccccattatctgattcagctgacaggtttttgggtttttttgttttttgtttttgtttttttcatgtctcttgcacattaatgttttatggtttgagatttgataggggaagtaatagtgtgagtgggatttatacagtttcctgctttaattgaaattagaaaaattcacccaacatcctttaggctatgagaactttggtttttttwaaaaaaaatcttcaatagatcatcgtccctgcgacgctgcaccaccaaaactccaagtcttgtttctctgcctgtcactactgggctctcaggagatgcagcaaacggctgccccctttagccacagaagcacagtgttctgggtaagcagttgaggggtaagatccaaagcatgtgccagtgtatcaccatggggtgagagtccagagacagcggttgttgagtaggccctggggtcggtcagctgtgccaagtggtccaggctcaggcaggggcagctttttgcattagagggcagatcaccactgctccactgctgtcaggggctcttcctctgtgcctaagaaccttggcgcctatgcttggggaactcactgctgtggaaatacagcctcgtgggtgtgtgggggtctgcctggcctgcagcagctccatgaggccagagcggggcctmtgtatgttctttcatcttctgatgaatgttgtccctcagagggaattgtctgaacagtggccccagagacatgttytatattaggaatttaaagtgacattaaaaactgcaacatctttaaaacatccaaccaaaggttctaggggcttcggggctctaggccttgctcctggatggcagccccccggtggccatcaagggcgctttggtccagatgtcccctggggcatctgtgcagagaatgtgcaaggtcaggcccaagtaggccctccagaggcagaagctgatgatgaccaagggggtccaggccccttggggcctctcaactcattagcttctatggggccaacagggtaaaactgttgggaaaatggacctttcaaaaattctttttagacaatgtggactgttatttgtaaacttagaaagaggagggtatgctaaaacattgttttctcaaaacacacagacacacacacacacacacacacacacaaatgtcttcacataaaaaggaaagggaagagaaacttcctcactgtcttcagaattcagttactccttcacagctgctgaaggtgagcagcgttgtgatgaattcctggggtacactctggttcctcttgattcagtggtggagagtgtagaagcagatgctgcagccagtgagtgtcgtcccttgtggagtggccagtgcagaagttatcccttccccttgtgtttgaactaatctggggctgaaagcatactttccagctagtcttcctggtgatgaccttgacctttgatctggaaataccaactggaagcctggggagttccttctctttttctctcttttttttttttttttttttgacagagtctcgctctgtcaccaggctggagtgcaggggcgcaatctcgactcactgcaacctccgactcccgggttcaagcgattctcctgcctcagcctcccaagtagctgggactacaggcacgcaccaccatgccctgctaatttttgtatttttagtagagatgaggtttcaccatgttggccaggatggtctcaatctcctgacctcatgatctgcctgccttggcctcccaaagtgctgagattacaggcgtgagccaccacgcctagctgggaagttctaccgttttctaaggcttccagcaacactgagtcacagacctgggtgagtcatctgcacttgcagcgttcttcacaaaagcccccaacttgttctcagtgctgaactggctcccctggccatctctctggcatgtgattgtcagggccaatgaggctggcatggcctttgtgactaatatgtccccatgtgagaataagagataagttggaaaacatttgattccctggagaagtcttaacccttggcctcccattttcagtagcagcatttagagaagaaagtgtaattttgtgtttggtctttcaaatccatctctcttattcctttggaagcatcttcactttctccagaatcactgtattaaagccattcctcctctcccaatccatcctgcacccccttccagattcatctccccaagataacacttgactcttttatttctgtcttaaaaacttacactgactccctgttgtgtataaggtctgtcttgctgacttaaagtcccagcccttgatcctttacccttcccgtgactcctgtggagcctgcactgtagaaggctcagcttcttacaccctgttactcctggctcctgatccccaggtatactgcatattcaaagggcaatctagaagtctggtccctctcatggaatgttcccttcacgatagcttactgtcctttcggagccctgctgcacttgctggctgcgtcacacagcccagcactcagccaagttttgtctcactacacaggtcatcccaggcagcattcagtatcttctccatcttgacctcttctttccccaagggccttacayggtgctaggtaggtgactaatacattcagactaaattagattacctgaaattattcataattaggttaccagcatcatgtcttataaatcaatcactagaaaggcacttacttgatgagctacacagaaggaataagacagcccctgttctattctactcttattaagtcaagtggacaatactcagatatatggaaacagaaagaaaagcaaagaggtgtggytagaccccatcttaaagacaaaagaaaaagaagaggctgggcgcagtggctcacgcctgtaatcccagcactttgggaggctgaagcaggtggatcacctgaggttaggagttcaagaccagcctggccaacatggtgaaaccctgtctctactaaaaatacaaaaattagctgggcgtggtggtgcaggcctgtaatccaagctattccagagactgaggcaggagaatagcttgaacctgggagacggaggttgcagtgagcygagatcatgccactgcactccagcctatgcgacagagcgagtccactgtctcaaaaaaaaaaaaaaaaaaaaaagaagagatagacataagagatgttttgatcaaaacattaaccagaatgtttttgaagtgaggtattgaagggtgagatggaaagaagaataaagaatggccccacctgagtagcagggcattgactgttccatraattccaaggtggaaggagtatcacagagccctgagygaaggtttctgctggacaagagaagcagggaggatgagggtgtgctggaccgaggtgacataagagccaacgtctggctagatatgcagagagaggaatccaaggagatccgaaatggcatgctgtatctgaaaataatgaagtgtaatacaataatattttattgagtgtttgttttgggacaggccctagactgtcttaaaggcatcgtctcaattaatcatcttatcaagcccataagatagtattatccttattcagcagatgaagaaactgatactcagagagcagttacacagctagcaaatgtgcaagcttggcatcatacctcgagaccactacacagcccttccctgtggtgcctttgaacaaatgttttcactggcacaggccactcacaacatgaagtacactcagccactttttgtaagtcatgggggaagcaaacattgtgaaaaagacacccagagctcaccctcagttcacattccagccaattttttctcaagcattttattgtgaaaattgtcaggcatacagcaaagttgaaagaattttacagtaaacacctgaataaccaccacctagattctaccgttaacattttactatatttgcattatcacatctctttaaatatacatccctctgtacatccttaatccatcttgtttttttaaaataaatttcatctattagtacttttcctcctaaagcctttagcgtgcatatcattagcaacagttctatatctgcttacattttatgtaaaattaacatacaaagaaatgcacaaatggtaagtgtacctttgtgtgacctttgacaaatgtatacacctttgtaacctaaaccctaagaagacgtagaacatcactgccactccagagaaggtccttcttcctcttcccaattaatgtctgtcccccagtcctcagaagaaaccattgagctgattttatccaccatagattagttttgcctgttctagaatttcatctaaatggagtcacagtatttactcattcgtggaaggcttctttcagtcaatataatgtttttgagatgtatttatggttttgagtatatgatttggttgctttttactgctgagcactgttctattgcatggatataccacagtttgtttatccattctcccattgatgggcacctagattggtgccagtcttgagctattatgaataaagctgctgtgaatattcttatacaagtctctttgtgaatatatatttttatttctcttgggaaaatacctaggagtagatttgctaagtcatggattaaatgtgtgtttacttttgtaagaaactgccagttctcccaaagtagtttttagcatttgacatcgccaagaacaatgtatgagggattcagttgctgcacatccttgccaacagttggtttgccagtctttacaattgtagccattttattaggtgtgcaggtcttaatttgcacttctctgatgactaataatgttgaacaatttttcgtgtgctattggtcttttttaaatgtcatcttttgtaaagtgtctactcaaatcctttgctattttaattgggttgttttattattgagttgtattagttctgcatatatcctgatgaatacatcagtctattactaggtgtatgttttgctcatatgtactttcactctgtgagtttcctattcatttaacagtatattttaagaagtttttagtttgatagtttaatttgttaatattttatgttcgttgttttctgtgacctacctaagaaaactttacctaccctcaagtcaggaagatattttgtattttcctttaaaaacttagtggttttacatttaggactatcatccatctagagttagtttttgtgtatggtgtcagatgggatcaagcttaatatttttccatttggatatctattattcaagcaccatttgttgaaaagactttcttttcttcattggattgttttgacatctttgtcaaaagtcaaatgagtatgtaatattgatctgtttctggactctgttctttgcattgatctattggtcaatctacatattgcatgctttcttaattactttatagtaagtctcaaagtcaggtaatgtaagttcttcaacttaacattgcatgatttggtattctatgtcctttcaatttctatataaattttagaattagcttgataatgtttcccccaaaagcctgctgagtttatttttaggattacattgatgctgtagatcaattggagagaattgatatttgatgatattgattcttccagtccatgatatggggtagttttatgtttgtttggatcttctttaatgtctctcagcaatgttaagtagttttcagtatagaagtcttgcatatctttgttaaatttatttcaaagtactttatgtttgctgatgttgtgacaaatggaattgatttctaagttcattttctaaatgtttgctgccagtacataaacatacaattgattttttgccgggtgcagtggctcacgcctgtaatcccaacactttgggaggccgaggttggcatatcacttcaggccaggagtttgagaccagcctagcaacatggcaaaaccccgtctctactaaaaatacaaaaattagccaggtatgatggtgcacacctgtaaatccagctactcaggaggctgaggcacaagaattgcttgaacccaggaggcagaggttacagtgagctgagattgtgccactgcactccagcctgggtgatagagtgagattctgtctcaaaacaacaacaacgacaacaacaacaacaaattgatttttaaaattagctttctacttgtgaacttgcttgatggatttgttagtttcagcagctgctttatagattgcttaggatgttatacacaaaaagtcatgtctttcacatctatttaggatggaatcttggtctgtagttatctgttttttggataatgtcttcatcagggtttgtatattaggattgtgctggcctattaaatgatcttgaaaatattccctccttctctattttccgaacaagtttatataagacaggtgttatcacttccttaaatgtatgatagaattcacctgtgaaggtatcgtggcctggaattttttatgcggaaagatttttcataagaagatcttttttcccctaaatataggaaagttcagtcttttctgtttttatgtccatacaggtgagttgtagttttcagagaatttgtccatttcatttaggctatcaaattttttggcaaaagtggatcataatatcctctcatcatccttttaatgtctgtagactttgtagtgtaaggccgggtgtcgtgsctcacgcctgtaatcccagctctttgggaggccgaggttaggagtttgagactcagcctgaccaacatggtgaaacaccgtctctgctaaaaatacaaaaattagctgggtgtagcggcgtgccgctataatcccagctactcaagaggctgaggcaggagaatcactttaacctgggaggaagaggttgcagtgagctgagattgcaccattgcactccagcctgggcgacagagtgagacttcatctcaaaaaaaaaaaaagaatttgtagtgtaacctctctttcatttctttatttgtgtttgtgtcctctctcttttttattgttctgtctaggtgagatttatcaacttggttgatctttttggagaaccaacttgtaggctttattacttttctctattgttaatctgttttctattttgttgctttctgttcttatccttattatttcctgcatctcttttactcagcttggtttagtttgctccttttttctagcttcttaggtagaacctcaggtcattattattattttctgacaatttcattgaggaataactgacatacattaaactgcacgtatttaaagcatacagtttgatgagctttgttgtatgtacacacccatgaagccatcaccacaatcaagataatgaacatatctatcaacatatccccaagagtttccttgggtccctttgtattctttccctcctgaccctccttgccctcctttatttccaagcaatcactgattactatagaataatttccattttctcgggttttatgtaaataaaattagagagtgtatactcctttttgtgacatctttcactaagcatactaattctgagattcacccatgctgttgcatttatcagtttattttcttattgtaatagctttattgaaatataatttacgtaccatacaatgtatccatttaaagtgtaccattcaatggattttagtggttcatttccttttattggtcaatattattctagtgcattagctatcctttttatcattataaaatgttcttctttatagctggtgatactattttttcgtttttttgagacggagttttgctcttgttgcgcaggctggagtgcaatggtgccatctcagctcactgcaacctctgcctcccaggttcaagcgattctcctgcctcagcctcccgagtagctgggatttacaggcatgcgccaccatgcccagctaattttgtgtttttagtagagactgggtttctccatgttggtcagtctggtctcgaactcccgacctcaggtgatccacctgcctcagcttccaaagtgctgggattacaggtgtgactcactgcacttggctgatactctctatcttgtaatgtatttgatttgatagtaatatagccattccagccttcttatgcttgtttgcatgatgtatcttttcccatccacttactttcaatctgtgtctattgaaggtatattttttatggagagtgtataattggcttttcattttttaatcaattcatatctgcctcttatttggaatgtttagtccactaacagctaatgtaattattgatatggttggattcaggtctaccattttaacatctgttttttttgttttatttttattttcttttatataggtattttagattatttgaacgatttttaaaagccattttatttatccattggttttttagttaaatctcttggcatttttaagtggttgtcctggggattactatatacatctttaactacacagtctacttagcctaatatggtaccaattcatgtgaaacataggaacttttgaaactggaagtccatttaccaccttcccttttatcctttatgttgcagttctcatacgttataaatcccataatacggttactgtttttgccttaaatgcatgtgttttaaagaaattaagagaaaatttaatctactatgtacccaagtatttgccattgaatcttgagcactgaagatcggtgagaaggcagcatacacgcttgttctgtccttcactctgtctctggctaatcctgtgcctttgggcaaatcccctaaggacttggcctcagctgtctccctctgtagcaggtcagtaggtgtctttgcctacagactacagacagaaccagatacacacacacacacacacacccaactctaggttctctaattcttgagaaattgcattgttaatgtggattttagacactgaaacagttcccagaggatacagctgtttttcccaggaaacttttacaatagctgccatatacgtgatggtgtagtcactgtgccattgcccctgatgtggacactaacgaagctctcagctgtgtttctaggacttctactggcagtttttgtgcgtcctgcccatccttctcttctgagatagacctcacctgcagcatcaaaaggagtagttttatctcttgagggagctccagggcccaagactgtgggaaccactgctgcttggaggcacaagatgaatcgccccaggcagggagggtcaggttagacagctgggccagtctaaactgttacctggacagaaccaaaactttggcaaaaagtatttaaattcctgctttcagacatgaatttcagctatgttttgctggcacattttcagcataatagtaccagaatctgccaaattgaaaagctaggagagaggacatcaaacttctctttgtttaaagtgagaataggtcccatggctgcatttgctgccacctgtgcccatctcccctccatcagccaggccaccccagaaagttaaatccctccttaatgtcctcctgcagctagcctgctatcacaaaatgccactcacagtccattcctaacggactcaggaaaagttccagtggtagtctagtaagtggcgctcagcgtgggcttgggtggcatttttatcgtgtctggaaggaaaaaactgctcatgtcacatgagatacatatactttaaaaaaattataaatgctgcttaattcatccattttgttgcccctttttagggtacaggagtgttaatactcactttgtgccttgatttctttttttttttttttttttttttttgagacggagttttgcccttgttgcccaggctggagtgcagtggtgcagtctcggctcaccgcaacctccgcctcccaggttcaagcsattctcctgcctccacctcctgcgtagctgggattacaggcatgtgccaccacgcctggctaattttgtatttttagtagagatgggatttctccatgtgccttcatttctagtggagcattcccaggccaaattaggtgaagggtctcatttcctaggatttcttcacaggtggcatccgtcctcagatgggctacctaggactagggatggctgcaggtttcaargagcgagtagcttgaatgtgtgattcaaggttatttagtatcaaatttgagaatgccccaaacttaccttttaactgctcgaccgcatggcaccaccttttgggaaatactgtctttgggcacttctgaactagttcrctgagagccagagctttatctcttgttctcagtcacatcccagtgcctagaaaattgcctagcacatagtatatgctcaacaaacacctgctgaatgaataatttcattgtgacagcactgtgtttgtcccttattagacagtaaatcctatgaatgcagggactgggacctaaccacctttgcctcacaggcccaataaatatttcttgagttgaattagaagttgaggttctaattagagatgcccttttttctcctgggggtaattgtttacaaaatgtaaacaaagttctaatgaacagcattttcagaaccttaggacacacagtgataaaactgttttacattcctctcgttattactaatttttccctgtgctgtcccctcgcctctgcactagctctcaagggacctgatttactaagctctgggcctgaggatcaattctatcttatgctaatcaagtgcaaatgaaggcctggtgtcattaagtagtttaatgactctctgttgagtgctagtgtaacaggggtggggaaatgttggatctctctcattctcttattctctggaccataatctaggaggcatgtgggtttacacagaaaagtgccatccgtcactgacaattctttaagaacaagaaactttaaacaaaatgaaatttctgtccctgtttatatgtaagtgtctgtcactgagcagcaaggggacacgggctggaggactgacagcataaaagtgaggagacaagtgtgctgcttgtgttagccgctcagcagagcaccccacatatgctcaacattgagcttcagaggaaaggaaactaaaatcaatcctgaaagagcaagcaatataaatgtcattgaatccagattctcaacaaacagaatacacctatgaaagagaaggcaaagagaaccagcatgatctgggccccattaggctaggctcgtgcttctcaaaggatggcaccggacctgcagcttcagcctcacctgggagcttgttaaacatgcagattcgtagtctcccacccaaacctgctgaaacaagtgatgggtgcagaacccagcaatgtggcttaacaagccttccaggtgattctgatataaagaccggcttaaaagccacgggctaatattgtctcatttgatcctcttagatcctaaaaagtagatgtgatgcttagttttaggtgtcaacttgactagcttaaaaaagatacccagaaaaagggtctatgcatcagatcctttaaaacagtaaaaccttgtttatgggaaggtgtttcccaaagagactggcatttgaatcagtggactgaatttgaatcagaggacaggaagatctgcactcaccaatgtgggcaggcaccagccaataagccaagggcttggatagaataaaaaggcagtggaagtgcaaatttgcccttgcttcttaagctgggacgttcatcatctccttcccctgacatcggtgctcccggctctcaggctttcagacttcgggacttatgctactgccttccctggttctcagacttgcagacatcgtatcatgggactcctcagccaccataatcatgtgagccaatttatataataaactcagctcgcttgctcgctctctccctctctctctacacacacacacacacacacacacacacacacacaaycccctgttggttctttgtctagagaatgctaatatagcaggtgttggtcgccatttaccaatgacgaaactgagacttagtaaagctctgtaagttccccaggtttatacaactagaaatgtaggtactggccgggcacggtggctcatgcctgtaatcccagtactttgggaggctgaggcgggtggatcatgagctcaagagatcgagaccatcctggccaacatggtgaaaccctgtctctactaaaaatacaaaaattagctgggtgtggtgctacacacctgtagtcccagctactcgggaggctgaggcaggagaatcgcttgaacccaggaggcagaggttgcagtgaactgagatcgcgccaccgcactccagcctggcgacagagcaagactccatctaaaaaaaaaaaaaaaaaaaaaaaaagggcatgtaccaaagatcttttctcaaaacctatggtcttttcactttattggtgtttctcaaactgtagtgtgtaattgaatcacctggagattaaatggcaaaatgtagattccaattcagtagtcagagagcttgmgagtcagtagttctaacaagcttcaggtgttgccaatgccgccggtacactgagcacaccttaaatacaaaggcttaatgtgttaatggggtgggccccagaactaaagtctcagcctcacctgagaactcttagatccaaatgcttggccccacccagacctactgagtcagcaactctggggatggggcctatcagttggttttaacaagcccttcaggtgattttgattcatgcataagtttgaaaactacaaatatatcatctttccatactagaaaactcagtattggccaagttatgaagtgtggtggttcttacattgtagatatttgaaagacattagagagaaactagacaagagaaaaaagataaaacatttaagcctgaatagtagcttgcattaagtgtttttctgtgagataaggacacataaatgattatcactgggctaaacaatgacagtacttctctgtaaaggctcttgcaaatatgtgtagaatgtagagccagtgggcacaagtactgggagctaagagaagttatgaccaagggacagtataatatctgaagatgtagacctggcattgcacaggaaaatgatgcttaaaatttttcaaagaaaatatatctaacagcagaagaagataaatctctgcttgtctggcatgcagaaaatgatctgggggaaaaaaacagcttgggatttttctttttaatcttgtgtaatcctagaaattcatatgcagtttcatctatatcaaaccaatgcatgttgctttgatataaataacattttaaattaccattaagataaaaggggagagatgctgttgcacttagtctgttagactcataaaatgtactgaagtggtatgataccaagtatcagaatcagcacccatgtatatttcttttctgtcttggtgctacagcatttggagaacttggaatacatgaaaacaaatgrcaacagcttgtgggtggctttgagagctatgtaaaggcagtcactgaggacaggggcccagagtgttgcaagaggtgttttgttccggtgtttaggagctgcttgggtgcggattttgagaagtgaatcttcaagtggtttttgaaaatagaaaagatctttgatctatgcatcagatccttttaatttcaagaaaatactcatcaaagttttttgagtaaagatgatcaaagacgttctgtactataccactcacactgtcatttcattacatgtaaatgaagggagggtctcaaatgactcagttcctgcgatcacatctctttatccagcattcagactccaattcatcaaagcagtcttgtcacaaacatgaaagcattcagttctgtcgtgaagttgcagatcaagaatgttcagtcttaaaagtgcttaataagtcaacgtttaaagctacagtgattatttaagtgaatagtacttttgttcatcttaaccaggttttttacccctttccataacattcaggggaatggaggatgagacaaaaacaaaacaatataattctgagtttgaaaaagtggatcaaaaatttcttccatcaaaacctgcattcttctatataaaatcaagaaacatttaaaaatcacttcctgtttcattgcaaatgtgtgtaagaatatgaacaatctttttgtttttaaaataacatctaccatttgtaccattccattgaatacaacaagaaaagtaacagactctgtcagaagctcaaggaaccaagttagggacaaaggtgcatttagatatttggcctccatttctcaccttcacaacaactctttgcctgtcagatttggcactatctgagcccatggatgtattttaaatggacatttctctcagcattttaccgtgaaacactgtaaattagtatttttagagacataactattaagtaaaatatataatggccaaattattaataacagtgttttcaccagagctatgaggcaaacagcctggtcaatctcaatctcttatggattcattttatattagcttttatacgccaggtactgtgttagcactgggtatacaaaggtaatcaagtgagacataacccctgcctacacagaacttatagatagacattattcaaataagtactgatttatgaactgttataaatacaataaggggaaagtccattgatagcatgtaacagaagggcttgaccttataagggagtaggatgggcaggaaatatccgggaagggttcccttggaaatcgtgtttgagctaagatctggaagacaaataggcagaggaaagactgtggactgggaagcttcccaagcagtggagctgcaagtacaaagactcggaggtgggaaagggcatgggagaacaagagggatggaaaggaagccaggatggcctgcaagctgagagctcagggcagagtggtggggatcagaggtgcacctggagagctggcagggaccaggccatgcagcagagcctcatagccagctygctgcctggaattgaccctaagaccaacgggawgtgggagttttaaacaggagaatgacaggattaaatacatagtttgcaagcttacactggctgatgagaatagactgggttgggcaggtattgccaagctcagatgaaagctgatggtacctgcgttctggtagtagagagacgcaagtgactttacaggattggatgatggactggctctggggaggagagagaaggaagcagcaaggatgacccctggcttgcatactgatatatctggtgatttaattgtgagttctgatgcctttgactttcagtaatgactcagacatttctaccaaatgctgtctaccttcccacggtgattctgaaatgggtgttgaaggaggcatccagtatttatttccttacttgtttgttattgtactgatcctggccttgactcattttagttgctaaaaagtctcatgattttttattttttgtttttgtttttttttaaataaaaggttgacatgaacacatcatactaagagggatgttttcatattgtttttagggttttctcctacaagagataggtttatgtcgcaaatgaatttaaattctataatttaaggtcatgggagaacttgggagcaggggaaggaggctagttcataaaatctatccatcataaattatataaatttaataaaaatcaatgttttaaatagttacctaagtaggtcttacacttggtagattgacagctgttatacacaattccctagttatggtttgaagcagtgtattatcttatgcccaggctcayagtagggtgtcccagggactgtgacatgacattaacctcactcctctgtttcaggctgttctgatttcgtcttgtttattttcataggttttgaaactacagttcagacttccaattttcagccatcaatccgtatactcagttgaacatacaattttcccaatactttattatgaaaatctttaaccatatagagttagaaggactgtaagtgaatacacatgtactcagtacctacattctgtaattagcatgttgcttgatcatataaccatctgtgtctccctgtagacatccagcagcccatctaatttctgacagatttccaactatcaaaaaaaaaagttgcatatatcagtatgtttcaccccttgtaacttcagcatgcacattattaactagagtttaayatttgttttcatctattctaaggtagaagttacatacagcaaaatacgtrcatcttaggcmtagccttccgtgaggtttttaacttttttttaattatacttcaagttctggggtacatgtgcagaatgtgcagatttgttacataagtatacatgtgccatggtggtttcctgcacccatcaacccttcacattaggtatttctcctaatgctgtccctcccctaacccccaccccaccctcckacaggccccagtgtgtgatgtgtgatgttcccctcactgtgtccatgtgttctcattgttcaactcccacttatgagtgagaacatgtggtgtttggttgtctgttcttgtgttagtttgccaataatgatggtttccagcttcatgttcctgcagaggacatgaactcatcctttttttatggctgcatagtattccatggttcacatgtgtgccacattttctttatccagtctatcagtgatgggcatttgggttggttccaagtctttgctattgtgaacagtgccacaataaacatacgtatgcatgtgtctttatagcagcatgatttataatcctttgggtatatacccagtaatgggatggctgggtcaaatgatatttctggttctagatccttgaggaatcgccacactgtcttccacaatggttgaactagtttacagtcccaccaacagtgtaaaagtgttcctatttctccacatcctctccagcatctgttgtttcctgactttttgatgatggccactctaactggcatgagatgatatctcattgtggtttttatttgcatttctctaatgaccagtgatgatgagctttctttcatatgtttgttggctgcataaatgtcttcttttgagaagtgtctgttcatatccttcgcccacttgttgatggggttgtttgtttttttcttgtaaatttgtttaagttttgtagattctggatattagccctttgtcagatggatagattacaaaaattttctcccattctgtaggttgcctgttcactctgatggtttcttttgctgtgcagaagctctttaattagatcccatttgtcacttttggcttttgttgccattgtttttgactaaatggcttcactttcgactagtctgacttcatgattaaaacataccaagtgttttagtcatgaagtctttgcccatgcctatgtcatgaatggtattgcctaggttttcttccagggtttttatgcttctaggtcttacatttaagtctttaatccatcttgagttaatttttgtataaagtgtaaggaaggggtccagtttcagttttctgcatatggctagccagttttcccgacctcatttattaaataggaaatcttctccccattgcttgtttttgtcaggtttgtcaaagatcagatggttgtagatatgtagtgttatttatgaggcttctgttctgttccattggtctatatatctgttttggtaccagtatcatgctgttttggttactgtagccttgtagtatagtttgaagtcaggtagcatgatgcctccagctttgttatttttgtttaggattgtcttggctatgcgggctcttttttggttccatwtgaaatttaaagtagtgttttttccaattctatgaagaaagtcaatggtagcttgatgggaatagcattgaatctctaaattactatgggcagtatggccatttttcatgatattgattcttcctatccatgagtatggaatgtttttccatttgtttgtgtcctctcttatttccttgagcagtggtttgtagctctccttgaaaaggtccttcacatcccttgtaagttgtatttctaggtattttattctctttgtagcaatcgtgaatgggagttcactcatgatttggctctttctgttattggtgtataggaatgcttgtgatttttgcacattgattttgtatcctgagactttgctgaggttgcttatcagcttaaggagatttggggctgagacgatgggttttctaaatatacaatcatgtcatctgcagagaaaatttgacttcctcttttcctatttgaatacctttatttctttctcttgcctgattgcccttgccagaacttccaataccatgttgaataggcgtggtgagagagggcatccttgtcttgtgctggttttcaaagggaatgctttcagtttttgcccattcagtatgatattggctgtgggtttgtcataaatagctgttactattttgagatacgttcaatcaatacctagtttattgagagtttttagwgtgaaggcctgttgaattttgttgaaggccttttctgcatctattgaggtaatcatgtggtttttgtcattgtttctgtttatgtgatgggtcacagttattaatttgcgtatgtctaaccagccatgcatcccagggatgaagccaacctgatcgtggtggataagctttatgatgtgctgctggatttggcttgccagtattttattgaggattttcgcatcgctgttcatcagggatattggcctgaaattttctttttttgttgagtctctaccaggttttggtattgggatgatgctggcctcataaaatgagttagggaggagtccctctttttgtattgtttggaatagttttagaatgaatggtaccagctcctctttgtacctttggtagaatttgactgtgaatccttctgatcctggacttcttttggttggtaggctagtaattactgcctcaatttcaggacttgttattggtctattcagggattcaacttcttcctggtttagacttgggagggtgtatgtgtccaggaatttatctgtttcttctagattttctggtttatttgcgtagaggtatttataatattctctgatggtagtttgtatttctgtgggatccatggtgatacccctttatgattttttattgcatctatttgattcttctctcttttcttctttattagtctggctagtggtctattttgatcttttcaaaaatccagctcctggattcattgattttttttttttctttttaagggtttttcgtgtttctatcttcttcaattctgctctgatcttagttattccttgtcttctgctagcttttgaatttgtttgctcttctctagttcttttaattgtgatgttagggtgtctattttagatctttcctactttctcttgtgggcatttagtggtataaatttccctcaaacactgctttaaatgtgtcccagagattctggtacattgtgtctttgttctcattggtttaaaagaacatctttacttctgccttcatttcattatttacccagtagtcattcaggagcaggttgttcagttttcatgtagttgtgcggttttgagtgagtgaggttttttttttttttttttttttgagatggaatcttgcactgtcrcagtgcaatggcacgatctcagctcactgcaacctccgcctctcaggttcaagtgattctcctgcctcagcctcctgaggagctgggattacaggtgtgcatcaccatgcctggtcaatttttgtatttttagtagagacggggtttcactatgttggccaggcttgtctcaaactcctgaccttgttatccacctgccttggcatcccaaagggctgggattacaggcatgagccaccaagcctggccttgagtgagtttcttaatcctgagttctaatttcattgcactgtggtctgagagactgtttgttttgatttccattcttttgcatttgctgaggaatgttttacttccaattatgtggtcaattttggaataagtgtgatgtggtgctgagaggaatgtatattctgttgatttggggtggagagttctgtagatgtctattaggttcacttggtccagagctgagttcaagtcctgcatatccttgttaattttctgtcttgttgatctgtgtaatattgacagtggggcgttaaagtctcccactattattgtgtgggagtctaagtctctttgtaggtctctaagaacttgctttatgaatctgggtgctctgttgttgggtgtatatataattaggatagttagctcttcctgttgcattgatccctttaccattatgtaatggccttctttttctcttttgatctttgttggtttaaagtctgttttatcagagactaggattgcaacccctggtttttttgctttccatttgcttggtaaatatttctctatccctttattttgagcctatgtgtgtctttgcacatgagatgagtctcctgaatacagtatactgatgggtcttgactcttcatccaatttgccagtctgtgtcttttaattggggcatttggcccatttacatttaaaaaaggttaatattgttatgtgtgaatttgatcctgtcattatgatgctagctggttattttgcctgttagttgatgtagtttcttttttttttttttttttttttttttttgagacggagtctcgctctgtcgcccaggccggactgcggactgcagtggcgcaatctcggctcactgcaagctccrcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggccgatgtagtttctttatagtgtcgatggtctttacaatttggtatgtttttgcagtggctggtactggtttttcctttccatgtttagtgcttctttcaggagctcttgtaaggcaggcctggtgttgagaaaatctctcggtatttgcttgtctgtaaaggattttatttctccttcacttatgaagcttagtttggctggacatgaaattctgggttgaaaattcttttctttaagaatgttgaatattggtccccactctcttctagcttatagggtttctgcagagatatcygctgttactctaatgggcttccctttgtgggtaacccgacctttctcactggctgcccttaacattttttccttcatttcaaccttggtgaattcaccaattacatgtcttggggtgtcttggggttgctcttctcgaggagtatctttgtggtgttctctgtaattcctgaatttgaatgttggcctgtcttgctaggttggggaagttctcctggataatatcctgaagagtgttttccaacttggttccattctccccatcactttcaggtacaccagtcaaatgtaggtttggtcttttcacatagtcccatatttcttggaggccttgttcattccttttcattcttttttctctaatcttgtcttctagctttatttctttagttgatcttcaatctctgatatccttttttctgcttgatcaattcggctattgatacttgtgtatgcttcatgaagttctcgtgctgtgtttttcagctacatcaggtcatttatgttcttctctaaactggttattctagatagcaattcatctaaccttttttcaaggttcttagtttccttgcattgggttagaacatgctcctttagctcggaggagtttgttattacccaccttcggaagcctacttctgtcaattcgtcaaactcattctctgtccagttttgttcccttgctggcaaggagttgtgatcctttggaggagaagaggtgttctggtttttggaattttcagcctttttgcgctggtgtctccccatcttcatgtatttatctacctttggtctttcatgttggtgaccttcagatggagtctctgagtagacgtcctttttgttgatgttgatgctattcctgtctgttagttttccttctaacaggcccctctgctacaggtctcctggagtttgctggagatccactcccgacactgtttgcctgggtatcaccagtggaggctgcagaacagcaaagattgctccctgatccttcctctggaagcttcagcccaaaggggcaccagccagatgccagccagagctctcctgtatgaggtgtctgtcggcccctactgggaggtgtctcccagtcaggatacatgggggtcagggacacacttgaggaggcagtctgaccttagcagagcttgcacgctgtgctgggagatccgctgctctcctcagagctgtcaggccgggatgtttaagtctgctgaagctgtgcccacagctgcccyttccccaacatgctctgtcccagggagatgggggttttatctataagtccctgactgggaatgctgcctttttttcagagatggcctgcccagagaggaggaatctagagaggcagtctggccacagcggccttactgagctgcggtgggctccacccagttcgaacttcctggtggctttgtttacactatgagggtaaaaccacctactcaagtttcagcaatggcagatacccctccccacgccaagctcaagcatcccaagttgaccttagactactgtgccggcagcgagaatttcaggccagtggatctgagctttctgggctctgtggaggtgggacccgctgagccagaccacttggctccctggcttcagtctcctttccaggagagtgagtggttctttcactggtgttccaggcagcactagggtatgaaaaaaaaatcctgcatctagcttggtgtctgtccaaacggccgcccagttttgtgcttgaaacccagggtcctggtggcataggcaccagagggaatcccctggtctgcggattgcaaagactgtgggaagagtgctgtatctgggccggaatgtaccattcctcagggcacagtccctcatggcttcccttggataggggagggaattctccgaccacttgtgtttcccaggtgaggcaatgccccaccctgctttggctcaccctccgtgggctgcacccactgcccaaccagtcccaatgagatgaaccccgggtacctcagttggaaatacagaattcacctgccttctgcggcgatctctctggaagctgcagacgggagctgttcctatttggccctcttgtctgcaatcccttccttgagttttgacaaagcatataatactggaaccttatccccatcacgatattaaaccttgccgtcccaaaagtcccttcatgccccttcacagtctatctctgtccacccatcctgctcgcccccagaggtgaccacttttctgaattacttaaccatagattagagtttgagtgtatactgtcacggttggcttctctcactcataatgtttttgaggttcatcttcactgtatcattttttttccttkttattactgaatattcctttgcatcagtctatcgcagtgtggagaatctacttctgctgatggactccagggctgtttccagcttttggctgctttgaacattcttggacaagttttcttgtgaatatatgcttctgtttgccttgagtaaacacttaggagtgggactgttgggctgcgtagtaggtggatggctaattttaaaagaaactggcaggccttttttccaaagtggttgtacaattttatactccctccaactatgtatgagagttccagttgttccatagccttgacaaaacttctttttaattttagacattctggtgggtgtgtagataaataggatttttaaatgattaagagacaaatgaccctgaaatcatgcacacatacacacaaatacctaactcagaattaatagtgctttttagaaccaagcaaaatcagatgtttgtaaacaaagcatttagcacaaggacagcaaaatttgtggcaacttataatattttgaagtaattaagggtttgaaattatttttctccctgaaacaagctgtaagcctccaaggacttgctgaggaatcccagcttcgagctctggcaaagagcttcacaggccaaggagagcagtattcacattgcacaaactaagcactaaagccttcggtttccccagtaacacacaaaatcaaacttcccagtcactgctgcaaatgagaatattctacattttatgcttttacaagaggagaaacacaccacactacagagagactgactggcatggggcattgatgccattgaatccccgtccctttgctttgagttagtttgcacatgacaaaaccttttgataagagatactcacacgtccccccaaatttcaaggaaaactgtgtttcagagagatgtcccgcactaatgcagggggtgtttccttgaccccagtttaacaagcccggtcctggcacatcccttctggggcttcactgtaaacagcagcttgacagagcaaatggttttagagccaaagggacacatttgaaattggctctgcatactacctgtgtggcttgggcaagtttcttaacctcttaaacctcagcttccttgcctgttccaagcaatgaggatacctccccttgtgcaagagtgccatcatgattagactgcagatgtcatgctgccagcatgtgggaatacacgtaagagatggctgtggagcaaagttcatccccttggctgcctaccggagagaatgccaaaccacagacccactcattctgtatctattctcccaatgagctcaactaagtattaaggaaataattttagaataatttctactgaaatgactggtaagtgtagggtccacaagaaaattctgattctaggagaattttcatccaagtgaatcattagttgtacagtggggtatctggaagaggtacgtggataatcagagtcagcttcagtgaaaacccagcaccgctggggtgtgacaggggaaggtctgctggcactgctctcggcacagagcatcattaagtcggtcccacaatagggttcctgacggcagatgctgctgcagccaggaagagtctctgcttgtagagcaaggagttatctccatgctgggttgctagccataggcatgcagagagcccagcaaaggcaggtgagccagtctgggggtgtgttcagctcaaaatgccaaattatacttgaagaagaatggcccagagccacctcagcagatggaattggtacctgtcatccctgcttctccctgtacctagtggctggcatacatttccatccccaaagcaggatgtgcatgtgcacctgctggccttgggctttatctggctccactctagacagaacacaaaacccatgttgacatcgcaggagctccacgagccaatcggctggcccgaggggcagaggatacgcaagaaaggctttttgttgtgttttgtttgttttttgttttgtttttaaataacatagggagccatgggacacagcttctaaaggagrgaggcgttttgattcagaaagaaaagctaagcacttaaaaatcacttgtttttgtgttaaagctatttgaaagaacaatttgcaaggcaaaagttttattcatttggtatcatataaaaaattcacactatatcagtaagtagctgtatagcaaatggtctttatccctgaagaaaacatgaaacatgggaaataaaaatgtcccataattatgggataaatgagtcacagcccttagtcacattttgacaaggatatcacacaggttggtcatgtaattgtttccataattatgtggaatggactgagcagaagagttggtagaaaatcctattttcacgcttcagttttatgtgatgatttttcagtggttcagtcaagctgaaaccttttacctgtatctgtcatacagggtgttctgcagcggacaggcctatgcagacctaccccccaaagtctgaggaagctgagaggccaaagaaagagactgacaactctagttgtcagaaaggaacattaataaraacttaagaacagaagccctgtctgtgtctctggcagcagtgagacaagatggtagatctgtgcaccattacccccagacccagggcttatataccatacagaaagggtgattcagagggatgtgtaggacaactgaagtatgataacatcaaggttgtttgacctaatggcagtatttacagtaggtatgtgcttttacccaaggaacaatagataatttgggaatctttgaggccttctcagaactgaggttattcagaagacagcatggcagattagcatccaagatggagttgctttggcctccacactccagcctcccaaaaccagctcttaaaatctcatgcactcttcctcttctatgatggtctcttagcctgtagggagggtggctatagctttagtagcagtacattggcaatggaaaacagctcaggcccagtgggattccaaatgagggaggttcacaggctgttggaatcatctctagtcttaggaataccatgacttcagttttctcagaagaagtaagmcaatgagagatacttaacattaataatttgaatagtagaaatataatgacacttgaaagagaattcgtatgccagaacaacaacaacaaaaaaagcctattagccaactagaagaacattaaaacttggttcttctttagagacttgtagccaggaagtaattcaggtttagcccaaattgtaggcaaataataaaaactcaagaacagtatttcaggtccagttacagtggctcacgcctgtaatcccagcactttgggaggctgaagagggcagattgcttcagctcaggagttggagactagcttggccaacatgggaaaaccctgtctctactaaaaatacaaaaattagctgggtgtggtggcacatgcctgtaatcccagctactcgggtggctgaggcctgagaatagtttggacccgggaggcagaagttgcagtgagccaagtttgcacccactgctctccagcctggacgacagagtgagactgtctccaaaaaaaaaaaagaaagaaagaaaaagaaaaagagtggktaggactagaatctaagtttttctctctccagtttccccatttctaccaaggataaattatagtaccttgctatttcaggaataatgaaaaataaaaaataaaaaaattacaggaccaatttatttgctttagttgcaaaataaattttagtctcactatacttggcctaattatttgcttaaagtgtagcaagaatagttattagtcatataggcttcttttcaattggctttgctggaactttataaggaattttggatttgacattttaaaagccttgagactaaggattccccattagactatgcttgtaatacctatacataggtactatacctgtagaaattcctctcttctttagttcccaaaatatcttggttcctgggcctgtcagaaagtgatattctttacttaccagaggccgggaaccttgtaaggaaccatttagacaacgtaccaagttagtctttccaaaggactttttatcggctctataaagtcaatgtcaattcctcaaagcagtctggttatatctgaaaatacatgattctagtcaaagccttggtgaaataaccagtgtttccaattgtgtcctgttacaaaacaaaacagattcttactgaatttatgcaaacaactacattgccataaagtaagaatactcatgaaaagtttccaaattctggagaactcaggtagagggaagaagtaaattttgctcacaaaagtatcctttacaatcagagtagcagtcttccaaacaggatgttgcccgttcatcatggaacggccatccacaaaccaagcagctcttagtcaggtgagggagctgtttgtcaggcactgtagaatccagcagctcctcacacagtttcagagtcagtcctagggaaaaaagaggctctctgctcatgagtatctcctcctcgcactcttcaggtagcaagatcctatataaaccatttccattttatcatgggactctttttgggcactgtgatccccatcagagtgtttctctgacattacccccatatgccctagtaaatgattcactaagggctgtcaagtgaagaatttatccctacaagcactctggcatgctacattctgtgggctcaggcagtcttattcccatttagcatatccaattaatattgctcaaagggcagatttgcatgccttctcttctgtagtactaggtaggaaaaatgtttcagcagtcagatataatatccattttcataaaacatttaaggaaaagagatataactatttcacataaagactatttaaacatttcaactttcataattccatcagcccttacatttttatgttctgcttccaggaacttctcttttgcacccctagaccattttaccctcttgtcaaaaaggctttggctttgcagcaggggattgagccaagggacctgggcactttggtcaatgtgtcttgattaattacctcaacattgccccaggcaattgttgatcacctttctcattttaatctttaccttttgatttttcaaaaaaatattttccaatctagggtaaatacagaaaactggtttgggttcctgtaatgttgggggaaaagcaggggctcaccatggtccatccagcttttggtagtgttgtattaagaactttgtttgaaccctatcaatttccaattcattcaatttcttttttgagacagagtctcactctgtcacccaggctggagtgcagtggcgcgatctcggcacactgcaagctccgcctcccgggttcacgccattctcctgcctcagcctcccaagtagctgggactacaggcacccgccaccacacccggctactttttgtatttttagtagagagggggtttcactgtgttagccaggatggtctcaatctcctgacctcatgatccgcccgcctcagcctcccaaagtgctgggattataggcgtgagccaccgygcccggccaattcaatttattttttatttatttatttttttgagacggagtctccctctgtcgcccaggccagagtgcagtggtgctatcttggctcactgcaagctccgcctcccgggttcacgctattctcctgcctaagcctctccagtagctgggactacaggcgcccgccaccgctcccggctaattttttgtgtttttagtagagatggggtttcaccgtgttagccaggatggtctcgatctcctgacctcgtgatccgcccgcctcggcctttcaaagtgctgggattacaggcgtgagccaccgcgcccgaccttcagtttcttaataaccaagatttccaccctgctgggacaaattccatgactctccctttctgtttttcttagtttcaaccctttcaatttttaaaaatttaccttttaaaataacttttaaaattttcacctcgctaggataagtcctttgactctccgttttgccattccctatgctcttgttaattagcctaatgtttttattagcatctgtaagacccatgaggggaagttgagacagcaaatttgaggcttcctgaacttttaatttttcatcagtaacgaagtgcccacgcaaaagtccctcctaccccacccccaccccctcaccagacacacacatgcttaaccacagcatttaccatgacctgggtaataggcatattgatggggtggctatccctgtcataaagccagttccacatggcttatagacaaagcatatcagctgcttcatctggggtgctccacgtagcattggggccgaccccattctcagggtaaacagatctgacagaggcttttatccagtccaccaggctggctgttccytcaggaataacctcccatgtgtctggatcacatatagccatctgtgattgttcagtagtgagctggggatcgtgcatcaacccaaacatgttttaccactctgcagcatttaaaaccaaagacactgctccaaattagctactttcacaattcaacaamaggttttatccagggagctgatgatgcctatctacaaaagggaacaattccttcacacagtaccctctggtttcagcagttacttgggttttgcccttcccccacattgactaccttcttggcaaccacaggtctcagaggtactttctgttgccctgtcattattttcccctttgtagatagctttgaggctaatgatctgagctcagacagacccacatttgagcttggtgcagcctcaaggcccaatctggcactcttattttagcttttatagaaaataaccaaggtactgaatatttcacttttccttattggtttgcatttacttatgtatccagtgaacaactccttaggagttggatttttctctaaattccactggtaactcttaccttttagtaactgagcacagcacagctacagctccataccataggtgaccacgtggccgyccaggaatcaatcaaaagttcctcattctctatccttttatcctttccctttctatccatctagttttatctgtatcatttttcattcattttaaaacaacctttaaatagcctctaaactatgtggttactcttcctttaggcaaaaacctcatcttcatgtttttaataaacttctttatcaaaacacatctttctttcttcactttcatgtagaattgtttctcttatatttagtagttttaattacatatattaactactactttaactcktagtaaccctaatttccatggaaaaacctaggattacttaatttaacataacagattttaagatttcaaattactgaaaagaactttgaaactagttttatttgaaagattactaaagttaggtgaactaaaaggcatttgagttggtttctatatttccgataagaaattttttttttttttttttttttttgaggcagagtctcactgtgttacccaggctggagtacagtggcatgatctcggctcactgtaacctctgcctcctgggttcaagcagttctgtctcagcctcccgagtagcggggactacaggtgcacaccaccctgcctggctaatttttgtatttttggtagagacagggtttcaccatatttgttaggctggtctcgaactcctgacctcaggtgattcacctgacttggcctcccaaagtgctgggattacaggagtgagccactgtgcccagccagaacttactttttctttaagccaaattagagctctgtcatatattttggtaatgatgtatcacatatataacatactaaatatatatagacatacacacaaacagaagcagctcttatagacttataagattcttcatttgccagttctcaaatagcttctctcccacctttacacaacccacccaaagacatgactcagatgaaacaaggtggagaagatctacatctctaaggcacagaacttagacctaaacagcattatctggaaacaagattgccaggaaaaatgtcttctcttcaacttagcttgtttcttacattactggcttcaaggtgtcagtatattcttatattactggctttaaggaacagggccaagaaagcatggaagttttagggcctaaaccacacaattcttatccaaacatgccaagaaatgagtagcccttatagtagtaaccacttgctttaacaactgctgtcggccacctctaacaatatagctgttgcccgtgactgctagccattaggtacaaggtcagcaactctcacagtaaaaagtaatctctgtaccccaccccccgcctccccacacactaaccagagatgagataacacaatacaaaagagtgcagttttagacctgagtagaatctgtctgcttactacccttgggtttcatgaggaaaaagagattcttccctaaaagaggagtctttgatgccgtctgttttccccaagggatcccaggctgttggaaattccttttttttagatccctcgtgtggcaagaagtagtaggaacagacagaagtaaatggagaaacagaatttggtcagaagttttacagagagtgcagaggccttaatacatatgtaaacatatacagcccaaatttcagttttaactaagtttacttttgactgtagggcccttaaaaaaaaaaaacctttttcctaattgtaattcctaatcaagctgttttacttttttttttttgaaatggagtctcactctgttgcccaggctggagtgcagtggcacaatctctgctcactgcaacctctgcctcctggattcaagcaattctcctgcctcagcctcctgagcaagctgggactacaggcgcccgccaccccacccagctaatattatatttttagtagagagggggtttcaccatgttggctaggctggtcttgaactcctgacctgaagtgatcacccrctttggcctcccaaagtgctgggattacaggagtgagccacggcgcccgaccggctgttttacttttgtgtctgctgctggctggctcccgctaagacacagtcatcttaccgcactggctgcctgctgcccttccgggccacagtgtgatggttggcrctcagttcaccgtcactctaaacccgctggcatttggggtcatccccacactcacggggtggtccacaatcatctgaartgtgagccacaccattccacatagaagtggctgcccaccacaagatttcctccattttttggtctctcagctcctggcctggcttaccacacgtcagagtgggcaggcctgtgcacacctaccccaaagtccgagraagctgagaggccaaagaaagaggctgatgaatcccgttcctyggaatgaaacatctaataggaacttatgaacagaagccacgtctgtgccttggatggtggcaagacaagataacggatccctgttccattacccacagacccagcacttacataccagaggaaaggaatgtgtaggacacttgcagagaaaggcaagaatgctatgtgaatctgcctaagggcaggatttatggtcaaggttgttttgatgtaagggcaggatttacggtaagtacatgctcttcttacacaaggaacagtagataaaatagtaatattggaggccatcccggaactggggttaatcagaagtcaacatggtggattagcatccaacatggagttgctttggcctccgcagacagggtttctggctattacagttgatgttgctaagccatattaatctgcctctgcagatgtcctacacactcatctgtcttatttttcaagttaacctaccccattcattgagtggctacaaagatttaatggtctgagcacttgaaagtaggtkgatttagcagtgaagccgcatgattataagtttaatagaactaaatgtgccccactaacagtgttggggtcagttataaaacaagaaatgcaggatcccaaagaaagcacacttattatttctagtgctaatgacttccttttgtcayttgacagacatttattgagcattagcacaaaaccattaacaacaaaaaaaattgataatgagaargaataggtggaaaactgcatctaaagttcagatctcatcgtgagaaaacattttataaattgtctataattgagcatttgaagagctttgtaggaaatgtttttaactcctaggcttaaattcagattattctgtagcacagaaaaattttataaygtatctgaaacaaacaggttatatgttagccttataaataacttaaatttagttatatcttttatctttctgcatttctgtaggctgtcaaaatgagacagtagctgactggagaagtagatgtcctgtctagagagtatgtgccttgggtaccttcctgctctcaggctcagccattctataagtgtctgaaagtaacagagcctttggattagtaccacttggtgtatgtctttcatctgttcatattatatgtgcagcttcttgctttcttcaagtcttcagagctttttaactaaattgtttgatgagaaatatagcaaatggcatatttaaaatctttctcttgttttatcaaacttttgaacgactttagattcacaagattcatcgtgattcaggagacaattctcagacaggtgagaatacttcaattgaactctaacatacttaggaggcagctgtgggttcaaatgtatacatttctctgaagaagtctaagttgacatctactaccccagaatgtggagtgctaaaatccacgtgctcatatcacaaggttggcaagccagaagaaaagcagaaatcccttaaaatgtccttgaatcttcctttatggcaaccttatcatactgaaygccctccccatcttgtttttcttttcttggctagataccatgtaggacagataaacccaagagagtgggccgaaagtctaggggagacactggttgaatatgacacaggtgacaatatggtagttgctcaaccgtgtccagtctcccttttctttgcactaattggtgactgtacagttggaaaatgtggctaggtcctggcctgggaggcagaagcaccaagttcctatttcagtttcctactcgctcatttcatatgttgggcaagactctgcttggttcttggcttcctccataaaaagaggagctggacctgatgacttctacaagtggaaaggtctggaattctctgaccattagagggaaaaaaaatcagtctgctaccaagaagttaagatttttgtgcctgcaagaattgcaacattctttgccctgttggtggctttcccagccactaatgcatgatgtcagaccctaggctaagtgtttagtctctcttcttggtgaggtggatcatatctagcatacttagaaagatgtcatttgctctttctaagcttcaaattttttcatttgtaaaatgaattaacaaaagcccatctcattgttaatgaggattaaagaaggaaatgtataatgcttagcagtaactggcatttaacttgtaccttccttccccctttctgaaaactttctagacatgaacaggctgggataacataatgacacttcacacacaggtgcattttctctctctccctcactcacacacatacattttagttaatttcttgtaacacctgagcaggggtattattttaactaacttgggagcttctgggtgccacaaattgttccaagcatttttgtgtcctttgcagtgcccagcattgccttgtacataatagacactttgcaaatactcagcaaatattggtaaattgaaaccattccatcttggaagtacagtttccaccatttattctctttttgatcttgggctacctacaaaatctctccatgcttaaatttcttatcagtaaaatggggatagccctatgtagttttgagaattgttgtaatgattgaatgagacaattatttaaagtacatagcacaatgcctgtcacaaagtaggcactcagtaagtggagctatttttttttttcaattggtggcacatattcctttttgccacagagtacagctgtttaaatgtcctttatcctttctctggcttaagtttctaattcatgtaaacatctgttgaaagaatgacaatgaattctttaattatgtggccttactttagcctttattgaagaataatttctctaaacttttaatcacttctattgctatagattctcttaattttaactgagataaaatgaggaagaataaacatcatccatctttgaataatttctaatgaacgacttagaattcaaccagctagcctgggccacagccttgaagctaacctctcttttagttttgtttagaaactacattttgaggaattcttggttcttgaatcttgaatttaatcttaaatttttaagttagatttaacttattacttggtacacaaataaatgctaggactgtatatgattatgaggtccctgaataggctaaaccaagtgtctcacaagtgagcagtattagtttcgtttctcagggattcagaaatgccatgatcccaacaatatcacttaaagtactattatttatagataattgtaaaaatatatatatatagaaacttatatgcaaggataggtaaactactaaggtagaatttggaagataaaaattaggaaaagagatagtataataaatattttaagttagattatttaagataaggtgctatagctatggtgttcagattaactttataatagttccgctttcacttcatgttgtataaaaataattcagttttaatttttgatttaataatttttttagttgaatcaggtttttaggacactaaagtaaatggttaagaaggtggtctagaaaagtgtctaagacattataaagtgaaaacagtaagtagtagaacaatgtaacatgatcacatgtgtctaaagacatatatgcaaatgaacggatgtaattaatagcccccatatactacatgctcactatgtggcagacactgttctaaatgctatgcatatattaactcacttatttctcaaaacagcctataaatgagatgctatcattacccccacttcataracaaggataatgagacccagagaagttaagtaacatttccaagattacacagctgctgagtggcacagtagaaatttgaatcttgacgatttggctctggacctggtttccttaactactaggcttcttgcacctgctgtcactaggcaattcttaaagaagtgttattgcatcttttttttattcttggaatatgatcacttattggcatctgagaagcgcattcttcctgctgaaatttgcatgtctgcctcctctcttagcctagtgaggagtaatctgtgttatggttaaatttctctactcgcttatgagttactctcacagaagcaaatgcgctgaaaatgtgtgtttctgaagccaacactgctgccttgtcattttttatatctcggcgctcactggtggcatatgctttttgttagtttttacattaacatgaccgtgcgttttcagtgttaaattcaagtctgcaaagatttaggccaaaattcttyaaatgtttgcctgcccccaccaccctggaaaatagggacaagggtgaaggtttagttattgaaatgttgggggaatctaaaactgttttcttcctttcctgtgatcagcagtatgcatcatttgatgaaatccatccttaaagagaatctagaagcccatctagaggtctgacttttcagaggtgccaaaattcgtctgaattaatctcgtaatttaaatctctataagtttcattagtattatatttcctcaaatatccccatttaaaagccttccctatccagttgaatatattgtctttcaagtaaagatttaaagtactattatttatagataattttaaaaatatatattgaaacttttatgcatgataggaaaattactaaggaagataaaaattaggaaaagagatagtataataaatattttaagctagattatttaagataaggtgctatagctatggtrttcagattaactttataatagttccacctttactagttcaatagttcccccgagaatgtccctcaagttttaatgtttattttcttaaattctttttttttttggagacagagtttcactctttttgcccaggctggagtgcaatggcacaatctcagctcactgcaacctctgcctcccaggttcaagcgatcctcctgcctcagcctcccaagtagctgggattacaggcatgcaccaccatgcctggctaattttttgttkgtttttttgagacagtctcgctctgtcacccaggctggagtgcagtggcacgatcttggctcattgcatgcaacctctgcgtgctgggttcaagcgagtctcctgcctcagcctcctgggtagctgggattacaggcatgctcaaccatgcccggctaatttttgtatttttagtagagatggggtttcaccatgttggtcagggtgrtctcgaactcctgacttcgtgatctgcccgtctcagcctcccaaagtgctggacttataggcatgagccactgtgcccagcctaattttatgtatttttttagtagagacagggtttctccatgttggtcaggctggtctcgaaacctgacctcaggtgatccacccgcctgcctcagcctcccaaagtgctgggattacaggtgtgaggccctgcgcccggcctaatgtttattttcaaaattacattcatgtaactaaataacccttgatactaagctatattactatgatataacatggcattatcttaaaaaaccatcatttaactaatatgactataatttttgtctttcatgatttgaaaagaaagtggttgactgtttcttaaaattattttatagtgcttaaaaagtaaccttgttttctttagagaataaagaaaaaacatgtttgaatctcttctgtgaatacacggaaaactaatcaccttccctttctaatctgaaatccttagagcctcattcattcagatataagaacaggaggaaagagtccattgacgtgaaatcgrtatcatctcgaggcagtgatggtaagatgtttttcagattcctctgacctttttaaaatgtagaaaatgatggaagaatatgttaaaaaattcatcagcgtataaactccaaagagtaagagttcaacaacaccgacttatttttcaataagctcaaaggttttaggggttttaattattttaattatttttaaaaatcttatgctgtagtctttgtcgtctctttggagggactccatgcttgttccttgatgkcttgaagcatgttgagccataaccacccaagcaactcagagttttagtagctgaacaaggtcactcttgggtgctagaggcagagaggcagccagtcctggcttcccaactcccawcacaaacctagttttcagtgtaccagctatatgcactcacttcttaataaaatgtcacagagaaatcgtgaggcagaatttagcaaaatgtttctgccctgcaaggcaggatttagcaaaacattttttgagttccatcagccaggcctaagtaaacaactggatttgcagggagatggaaaagtcaaagacgattctgacatttcattcctcggtgtctgggaaattttaagtcatatatacagaaatggaaacgtctccaggttttgctaggttgggggttaaggagaagatgatgaatcttattttaatggagatggctaggaagctaacctgcaaccctggtactcggggctatagatgtggagttggcagtcctagtggtgacaggtgaagccaggagcagaagaacatctctaaggggtgtgtgatgtgcatgtagtgaaaggacagagggtccaagcctgagcctgaaggcrtagtctcagccagggggtgggcagtggaaatagggccagtaaagaggacagaagagctgggggtgaccatgagagtgcagtgtcacatgaaccaagaacaagaggggattgagaaaggcggtggccagcagtgttagatgctgtggatatcagaactcgagagcggacaacagactagtagatttcactcgctcatttgatttttatttggcaaatgggaggacacgttctggggtgtgaggaggggatggttagtgcctgtgatagaaaagagagatgaggctggtracttaagagagtcaacagaaaggacaagggagggactttccagtccttctgtacacagtaggaagactgagtatgaaagtggctgacataggccaggtgcgatggctcatgcctrtgatcccagcagtttgggaggctgaggcaggcggatcacctgaggtcaggagttcgaggccagcctgatcaacatggtgaaaccccctctctactaaaaatacaaaattagctgggtgtgatgacgcatgccttaatcccagctactcaggaggctgaggcatgggattcgcttgaacccaggaggcggaggttgtggtgagctagatcgtgcctccagcctgggcaacaagagcraaactccatctcaaaataaaaataaaaataaaaaaaatttaaaaagtggctgacatagcaagaaccaaagatgctagagacaagatgataattcacagggcatgtgagggacrgtaaccaataatataaagagaatatgaatcgagagatttttgagatggattgagcggatagatagaatattttagtctgagaggataagggatgagggaatttgaactggattcactgtttttggagcagaacttgaaggggactgtcttctttccagtacgggcacagtggaggctgaagagcatgcaggtctgcaatggctgctgcactagcagcggggggaccccagaggtggctgagcaggaggcaggctctgatgtggggtgggttcagtgatcccatccatgaaatgggactccccctcctgcctgcctcagagggggtggtaggaagatctgatgagaacagtgcttttcaagtcaagcttctacccttggcatcttaaaccaagtataaacattaactatgtagaaaaataaaagattttttaaaaaatgaaagcttctgtagatttgaactagaacttccatgggtttctgggagttaagagcctaaaggcatgggcaggcggagtgactggccctaattcagactgagaatgggctcaatcctccgccctgaccctaaccatgaactgcctcccctctcaagctggctgcacagtcatctggttacacggccagcagcttaggactgaaagtcatggaactgcaaaagttgggtttgggtgacttgggggaaagtgagccgtgtgggggtcattaagctgttggaatgaggcctttttggacctcatcaaccttctctgaaattccccttgtggacttggggctcagcaagccctcctgcctccaaagttccaggccagatcrcctttccagactcaggcaagtagcagttgggctaccagccttggcagaagagatgggtgaattcatggctttttaggtgggagggtggccctgtgagaagcgggccctggtccatgaagggactcctttgctgcacttagccacactgagccaccggaactggacacagctttcttgccttctctccagcaccaagcctgcagaatcgtcgctatccgtccatggcgaggatccactccatgaccatcgaggctcccatcacaaaggtgagtggcggctgctgcctgcactctgcagtcaggggccctcacacagggcygtgctctgaaaatacatcacactgacatcatggagctcrgtctagtggaagaagcaaataacaggcaaataaacacatagcaaataaacacctcatcctaagtcacaatcagggcagtgaaggaaaacaagcgggttctgtgagagaaaattagagtagggcccttaagtaggttggaagagagggtggtcagggaaactctcagtcatgtttgaagcaagtcttgaagcataagatgttactcaggagaagaaggaagagaagactccgggtagcaggaacagccagggaaaaagcattgcratgggcgaagagggactggaacatttaaggagctgaaagaaagtcggagtggccggagcttggtaagcaggtgagagaggaggaggatgtaggttgtacagggctcagctcattctggacagcagggacatagttaggagtttgtatcttagtttatgtgcactggaaaccactgaagagtttcaggtgtggggtgggtgatgtgaccagatatgtttgttgaaaagaacacccagcttctgtgcagagaatcgattggaggtggcaagagaacaggtcagttagggggctattctagaagtagctgagctagaattatagctgtggaggtggagagaaatgaatagatcaagaaatattttgaggcagaccaataggacttggtgatgaattatattgccagggtagggagaggaatgaggaaaagtattatgtcaggcatggccctcccaggtttttggtgtgagcatgaagtgctttcttgatagaaaatgacatgagatagaagtgctttcttttgcagtgtagaaaccacagaaggtgaacagcttttgtctttgatttttttgttgtgtgtgtttatgtgatttctatggagagaggggaacaagaytgcagtttagtgttagacctgtgagatattccagtaggtatgtcaggtagggaattgaatgtacaagcctggaggtcaaaggaagttgagggctgggaggtatatcgaaagtccctagctataggtgtccaaagtcgtggagacaaaatatcatttctggaagcgagagagtgagagaggggcccagaacagatctctgagcaacyccaatctgtagaggagggccaggggaggtgaatctgcaagggagcctgaggaagcctactcactgagacaggagaacattcaccaggagcccgcagggakaaaagcatgcttcaggaagaagggcggtgccgtgaaagcactggtcattttgaataagagatggttacccactgatttcttttggattctgggcatatatatgacttttgggaagtagaaccctattatcctcagatgtattctttcttcactccrttaggttataaatataatcaatgcagcccaagaaaacagcccagtcacagtagcggaagccttggacagagttctagagattttacggaccacagaactgtactcccctcagctgggtaccaaagatgaagatccycacaccagtgatcttgttggaggcctgatgactgtgagtgatgaggcaaaacctgaaaagcaagagaggtatccggggcctctagagtgcagctgatgtggaaacygttacctgtggttgcagaagtacctgttatatagactaacgttagcataaccagaagcaactgcgtcagaatttatgtataacatgtgcagtggtatttgagtgactcttgcatttgtctttccatgaggctggcctaccatagccatggggacagtgtttcagaattcctatgactgcagggagtcattgggcaactgatggagggctcaatgtgcaagatggggctttgcaggctcttgattattcctgctttcccttgatctggtatagtattggatttcatttccatggacctcagattcctcatgtaatgaaagggtttattgttagactatagcatttaatcttaactatagaatcctttatttaaagtttgtatagaagttccatttataaggtaaaagcagactggggctgttctggctcagggaggggaaggggagaaggaacctctcactgccacattccaaaaagaaccatttacaccaccaagagtagctggtttctagggactcaacctattctggtgttttgctgtgatctatttggctttcataattatctatcagcaagtaaagaaaaggaaaaaaattcaaattgtttatttgagttccccatcagagtctgaagctggaattctttagaaaaaaagtccagaagtcatgtatgagtttgactttgaaggtttctgtccagccctgcagccaaatgctgaatgttgactgcctttcccctccattctccacctggaacttgagggccttcttgtttctttcttgcccctgggctggcctgttaactccatctaatgcagtgcagacctcagcttctaggcagcactgccaagggctctgcaagaaggtggccaccgcagagctgcagtgggaggggtctggttctgggagcaagccatgttccctccctcccctgctgctgatgcaggacaggcaagtccccaaactggggctcagcccgggagggttcttggcctcgcccaggaaataatkcaagggcaagctggtggtgttaaacagcaacttctattgaagcagcagttgtactgcagtggcagagggactgctgcttgcagagcggggctaccccatgggcagtgtgcccctggtagcagctcagaggcagcactgcactcatctttatacctacttttcattacatgcaaatgaaggggcagtttttgcagatatttctagaatgagggtggtaacttctgggttgttaccatggaaagggtggaaaggtctggatgttgtcatggcaacggtaaactgccgtggcatgctggtgggcatagcttatggggaggtgcttctgccctgttctacctagtcctcaatttggccccatgtccgagtcccttctcctacctcactgccataccatcgtgggtttcctctccagagaatgctgtgaggaaccagtgagtgattccacctcaattttatgtggttttggggaagcggagcgagagaagagcaagtaaaaccaagaatctcttgccatacacacgttacaggcaggacaattgtggctgttgttgttacttctgtatttactcartttttaaaattaagctcttggcctaaagatccaacatgtaacttcaggggagtccttcattaattaatactactttaaaccttagcacacatcgtctgggaatgacaaataagcatttctttttttttwaatttaattttattattattatactttaagttttagggtacatgtgcacaacgtgcaggtttgttacatatgtatacatgtgccatgttggtgtgcatttctaaatgacttttaagcaaagatctagatgattgaggtactcagagatcaaaggtggagggaaggaaactgagattcaggaacacttggggactagttcaagagccaggatatggccaagcattggaatttcgtccactctcttaacgctgcatctccaaggacctcaagcccagaaactcttctttaaaaggcaagcagcaatgctcatgtttcaaaacataaaatacagttggggaaaaattagttgggatattagtcaaaaaatagctcaatctttttaaaactttatattagaaggtaatcccctaaatatggctgatggcttcaactcttcaaaatgtaagtcaaaaacacaattaacacagtccctctgagggtgagggggatcccgtcaagatctgaagcaaggtcactcctgygatttcacctgtgtagcttgaaaatgccaggagaggaagatggcctcagaacagagccaacccacagctcactgtgagtcctgacacagtcacatccactctatcccagttctccacgttctggggctaatagttacagaagggagagtatcrtctgtcttataactgttgtgatttaattttgagctttgcttcaacttagacttccagattggttgggttattcaggattcaaatctctttcactaataataawaaaaaaaagagaatgataatagatataaagcatgcttctaacaggctcttcctttattccaggacggcttgagaagactgtcaggaaacgagtatgtgtttactaagagtaagttttcatctatttacttgttagtgtaacctgtctccagcctgtgctgtccccgctgttgcgattattgttctgggaggtgttacttccagctagtcccatttgagtttaagcatcaatatggtctacatttaaaactagtctcctaattaaaattacttctctgagcacagttagagtaagaattgcaaatctctatacatttaaacagagttaaagtgaattatttttctatttgagggtcttgaagttcaataacagaaaaatcaggtacaagactttttttctagtagtaactatgaagatgatgacagacacccgggcactcaagattccacaattaaccagcctcccccatcccatctgtttgctcagatgtgcaccagagtcacagtcaccttgcaatgccaataaccatcaatgatgttcccccttgtatctctcaattacttgataatgaggagagttgggacttcaacatctttgaattggaagccattacgcataaaaggtatgtgacttctctggctgaaggcagagcaggattgatggccatgctcaaactctcacatttggaaactttgagggagacatgtttttgctgtgagagacctcacgggttctggctctcatgccatgttagagtagtgttgaatgagcagagakactatggcccctgagtgagatcctttgtggagagtattagtaagatgtgggatctgcctgggtatccacagctccctcctttgtgctagtgagccaagagttctaagaatcctcaaacttgtcgaagctctaccctacagaatggaattgagagcactatagatttttttttttttttctgatccatcctgtaggcagaggaaagattagataactgaaaggtctttttctatactaggagaaggctgtttcttcccagaggtgttggtctgttggatatgaaagattctcacctgtaacgtaaataagtaacaggactctaaatgataggactttgggaccatccaagctgtttttttttgtccttaggcttagtcacttccttagggaacataaataaagtgcaaggttaatgtggaagtggggatggagagggactgccaggctcatttctaggttgtcagagccactgaggggcctatgatttagagttcatctagaaataatttggatgtactaccatgaagcatctagttccaaagaggtgactggtgagaaggagagatcctacctcctaatttttagaggagatgcttttaaacccctgtgtgtgtgaagctatcatcagaagaaaaatgcttccatgccccactatcatcaaagaaaacagtttctgggccagtgaatacaatgagccagggtgggttttcctatttttcaggccattggtttatctgggcttaaaggtcttctctcggtttggagtatgtgartttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaaggtaggattttgatatcatgacctrgttacctgcctggattggagatccaagaacttaatcttagtaaatacattaggcaaacagctattttgcaaccaagttgacagcttttttwaaaaaaaattttgttaccrrattgactagtcactttggtgttgtaaagacatggacctttctgccagccctcccctcctccaaatacttaaaataattatatcaccatagagactcctttatatgcatggcagatcatgaacccattttccaaatgttagctaggagctgtgttackgggttgcaggacagaacttaattattacagcaaatggttactagatctataggttaaattttagtatcaggatttggccattggtagattacagtccagatattaataatagccattccgcattctacactgttttacatatatttatgtttgtgttttgtgtaggtatgaacgtgcctatctttatattaatgacttttgcataattctgaaagagttccatatcccttagtcttacagttcaatactgtcatgtaccactgctgatttgtagggcagccctaggaaccccttgccctttacataagggcagccctatttaaagctggcaagagatccccatctctcctcctccccagctaccatcacttgcacaccaaagcttatacattcttttgctacaactagaactaaaacttaaattttaaatacccctgggagaagtgccatatggggattgaaattcacatctatctgtaaatgcctgacattagatcattttcttagaaccaggtattgagggattaaggtcctaggtacttaagagctatagtgagacaggtagaagcagaaatggcaggaaaacagtaasggggtatgtggrtaaggttttcttctcagttttgccaacagcatcctgatatttattcactttcatcagcaaggaaacaatgtggcccaagaatgatgcttttgaataattttgtcttctacttttagaaaactaatagtgatatcaacctatgtttctataacacctttctttgaggagcaaaaacaccctggattcctactacaggttcatgctcctcttttttaaaatttttttatttttttgagatggagtcttgcactgttgcccaggctggagtgcagtggcacgatctcagctcactgcaaactccacctcccaggttccaacagttctcctgcctcagcctcctgagtagctgggactacaggcgtaggccaccatgcccagccgattttttttttttttttgtatttttagtagagacagggtttcaccatgttggccaggatggtctcaatctcctgacctcgtgatccacccgcctcaacctcccaaagtgctgagattacaggtgtgagccactgcgccyggcctatgctcctttcttttataccacatgatgtttcacagctgaagccacatgctaccagttgagaacagcacccaattcattaatgccaagaccaaggtgatcaawagcctctgcagtcttgagttagaggtgaacctcactcaagcggaaccactctaggaaaacattgattaaatttttgataaattagggaatgcttagtaacttgatcatatcttactatcctcctccaaaatatatttctttaaattgtgagttctgctagtgtatttggagtctgattagatttctcaaatgacagcaatagaaacaagtttaagattggacagaatatgtttacaattcaaaaaacattttctcatgctggcagcccctgccagagaaccagaaaacttagagctgcgaggaagcttggagaactgagctggaaggggtttctgggctcagaggtttggttacctgcctgtgatcactggtgggtccatcatgaggtgcttccagaaagatttactcctgaggcctcttctaccagatctgctggcactgacaaagagggtcaggaagtattttcttacttctcttgtgtcatctgtcacccctaatttctttgtgataagctaaaattttttttttttttttttttttttgagatgaagtctcactctgtcacccaggttggagtgcaatggcatgatcttggctcactgcaacctctgcctcccaggttcaagcgattctcctgcctcagcctcccgagtagctgggattgcaggcacatgccaccaagcccaggctaatttttgtatgtttagtagagatggggtttcaccatgttggtcaggctsrtctygaactcctgacctcagataatccacccacctcgrcctcccaaactgctgggattacaggtgtgagccactgcttccagccaggctaaaattcttaatgtcactatgacaaagcatgcccaacccagctgtagagctagcatgcccagagctaacagccccttcagttggtgacagaccccatcctctccccatgttacccaattccagggaactagtgcaagtggagaagccaggataacaagcattcctttattagtatctgrgcatacatgaatatttatcctgaataagaaactatttgaaagacagatctagaatgaaaccctttcctcagtgtgatccagatctactcctactggttaaagagggaaaaaactatgcagaggtaactgcacctccacgggactggaatttcgccagttgcgggtttggtggggttttcttccatggacatttcctcctcgacgtagggccttgctactctcctctgctagtgagctagcctgtcttccttccctacctcccagccatttctggtctgacaaggccttgttggtgcccacctaaactgcaggacccattattggtatctttgtaagtcactgagggcatggtttaaatcagtgttagctggaaggaaaggcatgtttcatctagtgctatttatgttttctaccccagttacttgaatctatttcattgaagaattaaaaaataaacaggcctgagactccaagcaggattgaacataccacagyggcactagctggaggcccagagtttgggccccgtgggttctcactgctcaggtacagtcagtgaaggtggagcccaggttggggctgtcctgggtcctgagcttggagatcgctgaacgtgcctgcaggtgaccgtggcctctcctgaccagcagtgaaatgggccaaatgatgcttgcttgccctgggcactgcagaatcaatctctgagaacagctgagaagagtaacttctgctgtccctattcaggaagcctagttgtgttgattggggtcaccccagggttgctcaccagctccatggggtcagcgttgggaatggaaatgactcccttctggtggagacagagctttcagggaagcctgctaaaccagcacaagcaagtgcagccccttggccatcagggtgccgtygcaggacagggctgagctacaggttcaccttcctcacctgagtagcagctcttcctcctgcaggcctaggagagcaaattctgggaataccaaaaatgatgacctccccacccccaacatcttggggaccactttccctctcactatcccttcagccacagtgatgtcgcttacgtttcctgaacagaccttttttgtttgacttcaggaacgtcatgcaggctgttctttctgcctggaattgccctcttgctgcttgttgcctggacaattcctgcttctccttcaggctcagcagaaaaatcacttccttggaagtgaccaccctcgaaatccatgttatccgatatggtagccatcagcctcgcatggctactaaataaaatttaaaatgcagttcgtcagttgcactggctacctttcaagtgtccagtagctgcatgcaactaggagttactttatcagatagcacaaatagaacgcattcctgtcatggcaaaaaatacattggacagtgctgccctaaactagaccaggtcccatggttatactcccaaagcatctgtactttccttcttagcacgtctcacagcaagttacttccgtttgtgtttttaaatgtatttgtctctctccctctacattacaaactccattgtgcagactgtgccagtgtaaatcatcatggcagctctggcactatgcagtgataattggtacytggtaggcactcaataaataataaattcctagcacaacatctcttatataacagtagcccatctgataactcctaaagctgcaggctcagaaaacacttgtatccccggatgctctggtttgtttctttaattacataatgagagctttcgaattagggtttccctttttgcctttgctgcctgctagcccagagctgaattttgttcttatttgcaagaacccctttagccttaattttcctggcaaagttattctttcccttggtcttcttttactgcttggtcctcttttacctggtactcttttactcttctacagctctagtcatttcaccattgtatgaayagttttgttgtatctgagccatttgctaccagcacactcaaaatcttttcagagctaggcaaattggtaatagttgtgatcacaggccactttctgctgtggcagaaataccatacagtgggcaattcaaaaggcttgtttggcctcttcctgcagctgatggcccctggagaatgaattaagcgtctgctgtaactgtggctcaggttgccctccagataacagacagcacagtaaagcgatgctgcatgtccgaggccgcctctccacatctaggtcagaaggctcagctggctaaaaacgttctgaaaatctcaaatcccctgacccgaccctccgcacagacaaggatggatgtgggtctccaagatccagtgggtaatgctcaaccttgcctccccatatcccagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggtttgttgtgctggggctcctgtgctcaagtttgtgaagtttaagtggttttcccaaatacttagcttcctcttaggggaaagggaaaatattagctgtcccactgtaycagatgataaaataaccttgcccttaacttaatttgacttttcagactgcctttatgttttgaaatctcatttggtcttcagtgagttcataaaaatgttttatacactgcagaacactacataaatattgattgtactattactaagtacaccagatatttttaccctcctacgaggacatcctgtcttttgtgtaactcgaggaaaatgtatccacccccatttttccctagctcaatttccggccgcttaaaatactccctcatgagtaggtcccacagagcgggagcacgaagggtggggcaggttaccccagccccgcattctctgatgagagtgggttagatgtgagcaggtcctcttgcctcccagcaccttgcagtcaggcttgtgggtatttcccacacagcaccagccaggctggtgcacagatgcctgggaagggggcagtgtacagagaacatggagctcactcgggcctcaggaatgctggtctatgtgaacctattggtttggtctccagaaaactgggaaaacatggagatgagttattccagctttggcttcagcttcatcagtatcgaggatgggtttttaaacttttgcagaaaaaattctttccagtagccaattttattcaagagccattctggctcttgaagttagaaaacgacgacagaattggatggttaatttggggcagggttgttgcttcattcattacaatttctatctgctgcagtctagagmattacttattaacaggaaagtcttccaatgcyatcattgaaagaggctgtggccatcctgtgcaatgggaatccctgtgtttgcacagagtgcagtgggccagcttatgtggctgccgtgccagcctgccatttcctgccaccttactgttttgatgttctcaagggaagggagaggggaatcaccttgtcagataaacgtccaccatgtgacaggtaccttctctcttttttaaaatactcataratcacataagggtcagctatcactggggaaaatggaatagcatctgcaagtcttgcttactgggaggacgagctcttcttgtgatctgcacacatttcttaactctgtgccccagcttcctcctaggttgtgaggagtgtagtgaaatggtggcagaatagttataatttgagacacgctgtgaacaagcccctttgtcttgtggttattttaggaaccattatcgaacgctgcgccaggctattattgacatggttttggcaacagagatgacaaaacactttgaacatgtgaataagtttgtgaacagcatcaacaagccaatggcagctgaggtgagtactgctttccatgccataaggcacatccaagtacatttccrtaagagcctgctctggccctgaagcattttctctcccactcaaatrtaaggtggttatttacttggagttgataaagggctgaaaggactggccacttgttttccttggggatgaaaataaactgtgtccacagcaactctgagctccttgaaagaaaggccctgagaaaaagccagtactgaccagaaaagcttggcccaaagaatatggaaggagacgcagacgaacagagactggcataaatggtggtattttagagaatccaaagcctttacttctstgttcactgagctcttggaaaacctcaaagttggaaggtgttttaaaaaacaaagaatgttcctgattcacattaaaagcataccagtacctgaagactatcataaaactgggagtgactggaaagcagaagcatttattgtgttttccttttttaaaacctactcatgtaccttggacctgccttaaggtccttaccaatttggcttttaggaacatgaaacagaaggttcacacctaataagatccactgttctctgaagccatgaagctgttcataaccccataaaggtagaaaagctttccgctcattcctgttgagcggcagaggttggcaaactggatggatgtgaatgatcatcatgagtaacttgctcagtaaggagatgatctgtgtaggacccatcccatgaccagtctggatggagtgacagtgtctacctcacctatttaagccccttcccccagggattccacagcacaacaccagagccctctccttccacagaagacttacaggagcaaggatctggggatttagagaaggaaaagtatagagattcatagaactaggaaggtcatccactcatgtaagcccccacctctgcactgcaacttactattaactgcagtatttatagtaaasagtattactttgataagtartcaaaaacctccagaacatattctgcccattgatagtctaataaataggtccagtcttaaacccyccaaatgtcatgcagccttttggcttggcagagctctggagacctaattgtttttacacaatcaatttgatggtgtctttaaaagtggagaataacaatctttcaggttctatgtaaatggcctgtgatgtgtgtaccaactygtgtcctggccacatggctcaggacactgacatcaccactaggtgtggaccagtctttctaaacatggctgaacacacctgctcctgactacttcctactccaaggaccccacgcctacctggctcacttaccagccagtcagaagaacagccaagaaaacatgagtggacacatgccttaggagaaccaaagtgcgagagagttgggtgagttgggggtgggacaggtcataggagggagggagatggtaggcataagtagtagaaatcaagaaataattgaagggttacatgtatgtgccactgccctacctgaaatgcattaaagtagctaaaagctctgcttttacacattttttwaaaaaaactgggagaaatttcctctaagattacatatcaaattgctcaaaataaaaacaaaactgctgtagcagttacctctagggaagaaaatggatgtgaggggtagacaggtggtgacagggactttcaactttcaaactctgtgtgtgtgtgtattgctgagtgtcttttaagactgtatcagtatattctttttttaaagaatgtgtcagtatattatatatggaatttaaaaaaggaaaagctgccttcgccgagtcccagtcctacctgtgtgctcggtgatcaccatcgaatgcctggcgarttaacccttgtgggcttcaccgtcatcttgaaccaagcctgatctgaccatctgttttccagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacaggtgcgccatctttccagggaagctccacttcccctctgggaatgggaactaggtcatggaackcctgggggattctccagctgagtaactttttaccaattagttaaccactcctccctggaagaaagcagcttacccccacctggggtaggcttctggttccttcaggagctgactgatggggctgatcactaaccagagtctcttgagaagggggataaactgagcctttggaagtaacttttcatcttcagttkgctggatccagaacttgcacaaaaaccgagaaatcttccattcattcactaggttattcctgggtgtctacatggcgcgttatgggaacacaggcattagtgaagacatcgcggccrcggggagttccagtccaataggggagagatgtagataggtccacatgttagtaaaaaatgaagtgtatctcaaggaagtttatgttaagtgctacagacgttcagagagacttttttctagataaaaggggggctacagaaatggaataggaaaagactttctggaagaacaaagcattctgagcaaaattaacaaagggaggggaaatagaatttttrtaaaaagggaagagcaatatgtagttcactttaattgtagcagtgtagagagttaaaggagagaaatctagaaagcagtagactgtaaatggacatgtgaaaacagccctacttccagagaagagactctaagcactgatgggtgtgtgggtgacaaacaagcagccacaagtagtgaattttgtggggtctgcatggctgaaatgtactgtggaggcaggataaataagggcaggataaagaatagatgatgcctaggaagactgggaaggggagtgaccagcagaggagcccagtatgtttaagatttgggggtacatgtgcaggtttgttaaaagggtatattgctgatgctgaggtttgagcttctaatgatccatggctcaagtagtaaacatagtacccaataagtagtttttcaacccttgcccccttccctccttttgaagtctccagtgtctactgttccagtttctgccactgtgtgtacccaatgtttagctaccacttctaagaaagaacatgtagtatctggttttgtttctattattacttcactttaggataatggcctccagctctagccatgttgctgcaaatgacatgatttcattcttttttatggctgcatagtattccatggtrtatatgcaccacattttcttcatccagtccaccaatgatgggcacctgggttgattccatgtctttgctaccatgaattgtgctgtcataaacatgcaagtacaggtgtctcttcagtagaatgatttattttcctttgggyatatacccagtaatgggacggctgggttgaatagcaatttctatttttagttctttgagaaatctccgaactgctttccacaggggctagctgatctaatttatttctcaccaacagtgtataagcattcttttctccacaaccttgccaacatctgttattttctgactttttaatagccattctgactagtttgagatggtatctcattgtggttttgatttgcatgtctgattagtgatgctggacttttgttttgkttagttttttkttttttttttttttttttttgagacagtcttgctctgttgcccaggctggagtgcagtggcatgacctcagctcactgcaaccctcacctcccaggcttgagcaattctgcctcagcctcccaagtagctgggactacaggtgcacactgccatgcccggctaattttttgtattttagtagagatggggtttccctgtgttgcccaggctggtctcgaattcctgagctcaggcaatccgcctgccttggcctcccaaagtgctaggattacaggcgtgagccaccgcacccagcctggacatttttttttttatgtttattggctgcttgtgtgtcgtcttttgagaagtgtctgttcatgaaatccagtaagtagactgcagctttctgggaagagagcctctgaattgaagaaaagtaggacaggtagttctgagctttccagagagaagaacaggaagggagtgaggatcaaatgactccttgaacaccagtggatattttaaggctgcttgatcgactgacctgaaatgagcaagccaagccaaaagctgctcatcaatgggcttccccggacccacagagagaggacctgacgtactactcctagttgttctcagtgtgaatggaggatgagaaaaatgtgcttttaagttttttgataaaagcttcctatttaggtgtccttttcccaaaaagcaatgtactaatgttcataagccagggtgacctaaaaatgaaagttacaaatgaagcctttgagctggccttctggctyaatacaccaccaggaaatgcggatcctaatactcagctcaatgaatgatgatggccttagtttaatgtgcagaatactcagatttccacacacctcaaaagctgcaaggctaatacccaagtttgaacaatcatagtttgacagtcattctttccagtgaaaataatggtccatggataaaaacagctggttcagctcaattcaagtgcataagtgctttccacaagacaaccagcagattttggtatgcagttcaagtgtacgtgtactcccatttcatcacattcatcatmcagaatattacagagacatgtacttcgaaggtcaagatttaatacaattaataactcttactgcttcaaagaggtaattctcaagtgaaactggttctgtttttttgttttttgttttttktttttaatgtgagacaagatctcactctgtaacccaaactggagtgcagtggcagtcctggctcaatgcagactcaaaactccaggccccaagcgaacctcctgccttgacctcccatatcactgggattacaggcrtgagccattgggcttggcctgaaactttttttaagtgcaaacatgtggcagcaaataatataatgactatggctattaatacagtttggtgctagttcattgagtcatgctaaggtgttagcagttttacccactattgcttcttctcagtgtaaatgtcagtagttttggtatgagaattygtgyttgtatgacattgaacagagctttgactttgcaatgataaaagcagatcccagaaaaggggctaagtaccctgagatcaatgtgtcaggagatgctatggtatcacayagaaagaggcttggggccaggcacagtggctcgtgcctataatcccagcactttgggaggccaagggaggcagatcatctgaggtcaggagttcaagactggcttggccaatatggtgaaaccccttctctactaaaaattagctggacgtggtgacaggtgcctgtattcccagctactcaggaggctgaggcagaagaattgcttgaacctgggaggcggaggttgcagtgaaccgagactgcaccactgtactacagcttgggcaacagagtgagacactgtctcaaaaacaaaaaaagaggcttgagagtgggaaggtctgagtgtagtcagtgtagctcagctgacttacgtaagtctgaggaccttgctgagcctatttcttcattgagaaaactggataatgacccattttcacagggttgttctgagaaacaggatattactgtgaaagtgtctcgcatgtcctccagccctatgtggtggttttttcttacagactgatgaagagaagagacagggactacctgtggtgatgccagtgtttgaccggaatacctgtagcatccccaagtctcagatctctttcattgactacttcataacagacatgtttgatgcttgggatggtaagacagttactgttttgtcacccaaagaarattgttatactttacgaatattatctttagtgacacagggtgagcctaaaggtaaacaaaatatatttttaaaaatgtggctgtcagctttttgtggccaagtggggtggggtgcattctttgcatccccagcagctggcacagaagcttgtgtgcagaagacttgatggatttttgatagctrgataaacgagtctctgcctcttcaaaggacacgctgccaaagcttactgcagtgtttttctgtcgttggaggaaaactctagaaagaatgcaaaatgtatttagtttactctgaatcacaggttcttctgataatgtcactgataagcagcttttcaaaaaggacctgtttgcatttcagaaactagtgtttaatgacttgtcctcatgcttcgcccagggtgtgcctcctctaattctgatcccaaacttgtcccagacacccccaggcttataaatgctcctggggtctaagttcaccrgtttcttttgattcttttctgtctttgcagcctttgcacatctgccagccctgatgcaacatttggctgacaactacaaacactggaagacactagatgacctraagtgcaaaagtttgaggcttccatctgacagctaaagccaagccacagagggggcctcttgaccgacaaaggacactgtgaatcacagtagcgtaaayragaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacrtcgatctgaaggattcataaggagcttatctgaacagatttatctaagaaaaaaaaaaaamgacataaaataagygaarcaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaawgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggrgggccgtattaggaaaatgcaacactctctaataatttccgtgactagtaagagaaggaagccagttataaaacactgctggaccagaatgaccctataatttcctaagatcattctttatttctaatttaagatttttaaatttacttgccctccatgtcaggactggttagcattctgggcaaaaaaaaaacaagcctgtcagttcactcagaacctactcagctttagagagagaaacagaagggatgatcttgtgcccttgcgctatgtgaatatagccagagactgaggtaataaatatattttaaaataaaaatgacaagggatttgtacactgtaacactatgtagtgttacttctgctgttgcaagtatcttaactgttgaaagctaaactcaggaaatggagaaaatgtacataatatacattgacccattattttattctaaattgaaagtccaacttttagcagcagtctacctgcaactactgaacaccatcaggtttgagtccctaccagaatctcccatcatactgttatcccccatctctgtgaccttagggcatgcatgaaaacaaaagcaatctagtccctagggttggagactgccctctagacagtttttcatggcagaaaattagaatacaagtatacctcattttattgcattctgcttcattgtgcttcaaagatactgccttttctacaaattgagggcttgtggccaccctgcatagagcaagtctatcggggcattttcccagcatgggctcactttgtgtaagtgtcacattttggtaactctagagtagagtatttcaaatgtttttattcttgtatctgtcatggtggtctgtgatcagtgatctttgttactactgtaattgttttagggtactgcaaaccatgcccgtataagacagtgaacttaattgataaatcttgtgtatattctaactgttccaccaactagcggtttccagtctctccctcttcttagacctccctattccctgagacacaacaatatcgaaattaagccaattaataacctacagtagcctgtaaatgtgcaagtaaaagagtcacatgtctctcactttaaatcaaaagctacagataataaagcttagtgaagaaggcatgttgaaagcccaggcaggtgaaagccatgcctcttacaccagttagccaagttatgcaaaggaagagttcttgaaagtgttaactccagtgaacatgcaaacaagaaagtgaaacagccttactgctgagatggagaaagtctgagtggtctatatagattaaacaagccacaacattcccttaagccaaagcctaattaattcttcaattctttcttcgaagactgagaggtgaggatgctacagaagaaaagctggaagcaagcagaggttggttcatgaaactatccccattaacgtcagagtgcaagggacaacaacagcaggaagttgtccagatgatctagctaagatcactgaaggcgactacactaaacaactgagtttgtgaagatgaaatggtcttctattagaagagatgtcatctaggacttcatagctggggagaagaagttcaatgccagcgagtgtagttggtgcctttaagttgaagtcagagtttatttaccagtccaaaaatcttaaggcccttaagaattatgttaaatctactctgcctatgctctagaagtggaataacaaagcctagatgacagcatatctgtttatagcatggtttattgaatatttaagcctatggttgagacctgctcaaatttctttccaaatattactgcccattacaatgttacctggtcacctaagagttctgatggagatgtacaaggaggttcatgttgtcttcgtgccagctaccacaacatctatgctgcagtccatgggtcaaggagtcactttgacttttaagtcttatttatttaagaaatacatttaataaggctgtagctgccctaactagtgattcctctgaagagtctgggcaaagtcaattgaaaaccttctgggaagcatttagcattctagatgccactaagaacattctgattcatgggaggcggtcaaaattccagcattaaaaggagtctggaagaagtggagcctgaagatgtgaatgaattgctgtaatctcatgatcaaactttaatagatgagaagttgcttaagaatgtgtatagaaagtggtttctggagacagtcatttccacagtgaagatgctgtaaacatagttgaaatgacaacaaaggatttagaatattctataaacttagttcataaaggagcatcaggatttgagatgacagactctaaattttgaaagaagttctactgtgggtaaaatgctattaaatagtattacatgttacagagatctcatttgtgaaaggaagtcaattgatttggaaaacttcatcgctatcttattttaaggaactgccacagccaccccaaccttcagtaaccaccttagtcaacagccagcagtatcaagaccctccaccagcaaaaagattatgactcgctgaaggctcagatgattgttagcattttttagcaataaagtattcttaaggtatgtacattttttagaaatttaagactgtagtataaacacaagttttataggcactgggaaaccaaaaactagatgtgactcactctatttgcaatagttgcttttttgatgtggtctgaaacctaacctgtagtatctctgaggtacgcctgtataatgaccagaaggaatttgctgtggtacttacggtaccatttgcttccaaaattcatgtgatttctaccactccatttgaatagattactatcacaaaatactagcctagaacaggctaggaagtaaaacagttaagtctatggctcccttgtgtcatacaacttcagaaaacaactttacaaatgtatgggccaatgcagaatttctaaaggaaaaagcacgtgaataatgggagaaagtcttctgtaattgaggtagcttaagttttaatatttctccatagaacttttcatgactcaatgttgtttggatttaaagtagtcatataagcctttctcattcagtcttcagttcctgtttttagagctgcttggtgatactgggcactacagatttaattgcaaggccttactgcactgggcctcagtttcctcatttgtaacattatgccactggtctactcagatgaccttaactcttccagtctttgtaggtagttgtggaagcaactgtcaaagctaaaactagtaaaagaacttatggagattccctttagggtatatttgtagtatatttgtataatgaacaaataaatctgtaggttttctgtaagaagggtcagtctgctaacatcagtcacgttgccctttcttcatcagtagtttaagaatttcaatctttaatgtgtagactactttctaatatttttattttttagcaccaaaaggagaaaacatattgttacaaggctggttatagtgtctcaatggacactgcaaagaactacataaaagaagtctgtctcaagcagttcgtatttgagtcagtggtcagatggggcagttgcgctcagctgcagtccctgactccggaaacactgtgcctctcaaatgatctagagctcatccttggcgtacatgaggggcagttgttgttctagtacccatttagcccatggctcttcaagccaattcacactgggaaaaacacaccctcacaagatgcctatccatttgagttcatacaggttttagtagctagaactaaaaaacatttttaaaattatctaaacaaattggtaccaaagaaaacttgccatacttaaacagtatatatgttcccttttttggctgagagattcaagtttgtgctatatagaacactaacagttactaaagactaggaaaatttgcaggagaaaggctatttttaaacttcacaataattctaaaggaagccaaataataaaacttctaataaatgccataacttaactattacctctatttgtacctttcacaaggatctaggttcaaaataagctcaaaacacagcactcaccacttcaacagcagctcaaagtcaaatggaaaaacttgtggtatattctttggaggatatactaggacctgagaagcaacatgttcctggttggtaggtccacaaaaaatttaaacatgtagaattttatggactgacaaaaaaaattaccaatttaagtgatcaatatattaatggttttcagagtagtacccgatatttgatgttcaaggttcatgcatgtgtatttttaattccttaaactagacagcaaggtataagtcaccattctcctctaatttttgaaataatcttaaactgcgcaatccagattctcgctctccatttttccacaaaataatgagatgatcagcggagcacgtcactagtccatgatcttcaaagtatagaaacatctgtaaagaaaattaaaactgattatagggaccccgaaaagcagagaagtgtctaataccacattaacacatgtgcgtgtgagatatgtgccttaaagactcctttggatctgggtgtagaacttcatttcatttttcagtattggtaagtcacatacaaataatatctaatattttaatcagaattttgttaatattgttcaactacagaatagctatttttgtaaagtacatgaattctcatagttcttccagattttttcataatctgatttttcaagtattggttttacttaaccattacttatactgtataatggctatggaaaaaatgtctgaattctaaatttcccaagataaacactggcttcagctctctataaaagtagatatactcaatccataggtattaagtgtcagcactaggtttatggtccctaccctcaagaagattctgaaaagcaaatcataattgaaacaataaaggtaccaatgagagattatgtaatcaggtactaaataatgcagtatagactatgacatgtcacagaaattcagaaaaagcttcaaagggagaaaatgccccaagtaaggggaaggggcttgcccagtgaaggaataggctggaagctaagaataggaaaacagagtgttgacaaaaggcagcatgaatactatggggtgaagagttgtatcagaaaagtgaatcaatgaaaaggatgaggtcctcgaaggaaagggtgaaataaaagagaaacagggccgggcgtggtggctcacacctgtaatctcagcacttcgggaggctgaggtgggtggactgcctgaggtcaggagtttaaggccagcctggccaaacatggtgaaaccctgtctatactaaaaattagctgggtatctgtaatcccagctactcgggaggccgaggaaagagaatcgcttgaacccaggaggtagaggttgc

SEQ ID NO: 12391 - DNA, 78504 bp, Homo sapiens
ctatgattaatcctgtattttgcttatggaatgagatataaattgaagtacatttatttggatatggatgtcaaattgtctagcacaattaacaaaaagactttttcaatagtcttttctacactgactgcctttacacttctgtaaaaaaatcagttatccatatatatgtggctttattttggtactctattctgtcccattgatctatttatctcttttattgtggtaaaatatactaacatatttgtcattttaaccatttgtaattgtacaattcagtgacattaagtacattcacaatattgtataatcatcaccactatatacaaatgtttttcattggtctcaacataaactctgtactcattcaataataactccctatttccccctctcccatccctggtaacctctgttctattttctgtctctatgaatttacctattctaagtatttcataatagtggaatcatacaatatttattctactgtgtttggtttatttcacttaacatatgttttcaaggcccatctatgttgtagaatatatttaaaaattaattcctttatgactaaataatatttcattatatgcatacatcacattttatttatccattcatctgtggatggacacttgggatgtctccggcttttggctattgtgaatagtgctgatgtcaacattggcccaaatatctgttgagtccttgctttcatttcctgtagatatatgcctagaggtggacttgctgggtcatatggtagttgtatgtttaactttcgagggtctgctaaacgatttttcacagtggctgctccattttacatttctattaacgatgcacaaggactccaatttctccatatccctatcaacatttattttccagcttaaaaaaattataggcatcctagtatgtgtgaaatggcatgccattgtggttttgatttgcatttttctaatgactaattatgttgagcttcttttcaggtgcttaatgaccattcatataccttccttggagaaatgtctactcaagtcctttgcccagttttaatagggttgttttatgttgttgttgttgttgagttgtaggagatgtttatatattacaggtatcacttccttatcagatgtatgatttgcaaatattttcttccattctgtaggttttcattttcttggtagtatcctttgacgcatgaaagttcttaattttgatgaagtcaaattggtttattttttcttttgttgcctgtgcatttggtgtcaccgccactaaattttgccaaatttaatgtgatgaatattttctcctccaattttttttcttctaagagttttacaacttagcttttaagtttaggtatttgactattttaagttaacatttgtgtatggtataagataaggatccaagttcattcttttatgtgtagagatccagttttcctagtaccaattgttgaaaagactgtcctttccccattggatggtcttagtacacttgtcaaaaaaattgaccatatatgtaagagtttatctctaggctctctgttctattccattggtctacatgtctgtccttgtgccagtactattactttaacttcgtagtaagttccacagttgggaagtgtgagtcctccaaccttattttctttttcaagattattttggctatttgggaccccttgcaattccatataaatttgaggattatttttccatttttaggaacaagattattgaaattttgatagagattgcattgaatctggagattgctttgggaagtatttatatcttaacaatgttgtctttctatccaagagcttggacgtctttttatttatttaggtactctttaatttctttcagcaatgttttgttgttttcagtatagaagtctttcacctccagggttagatttattcctatgtatttaattattttagatgctattgtaaatggaattgctttattagttttctttttggattgttcattgctggcaagtaggaacaacactaattttttttgtattaatctagtaccctgcaacttagctgaatttatttattagctctataccttttttgtggattcttcaggattttctatatatagggtcatatcatctgcaaatagagagagctttacctcttcctttccaatttggatgctttttacttctttttgtctactagctctggcaagaacttccaatacagtgttgaagagcagtggtcaaagaggacatctttcttttgtttctcatcttaggggagaagctttcagtctttcaccatcgaatgtgatgttaaccatgggtttttcataattactttttatcctattgaggaatttcccctctatttctggttttctgagagttttgtgataaaagggtgttggattttgtaaaatgcctttctgcatcagttgagattatcttgtggttatcttcctttgttttattaatgtgatgtattacattggttgattttcttatactgaaccactcttccattcccggaataaatcttacttggtcatagtaaataatacttgttaatatgctgttggatttaatgtgataatattatgtcaaagatttttttcatctgtagtcataagggatattggcctataattttctctttttgtgatgtttttttctggttttggtatcagggtaatgctggccttgtataaggagttaaaaagtgtttcctcctcttcactttttggaagaatttgagaaagatttgtgttaattcttctttaaatgtttggtagattcatcagtaaagccatctggtccaggacttcacttttttgggaggtttttgaatactgtttcaatctctttacttgctataggtctgttaatattttccatttctttctgagtcaatttaaataatttgtgtatttcaaggaatttattcatatcttttaggttatctaatttgtgttcgattgttcatagtggtcgcatagtcccttttctctctgcaaagtcagtagtaatgtctccactttcattttcaattttagttatttgcattttctctttttttctttgtcagtccagctaaaggtttttaaatttttttcatctttgcaaaagaccaacttttggtttcattgatttgctctattttttctattctctattttgtttatctctgctctaattcttattatttccttcctcctactagttttgggtttcatttgctcttctacttcaagttcctatggtataaagtcaggttattgattttagatcttcttttttaatgtagacatttatacctataaatttccctttaagtactgcttttaccgcatcccgtaagttttgtcgtgttgtgtttttgtctctaggtattttataatttcttttgtgctgctttttcttgtgactcattggttgtttgagtgttttgcttaatttcaacacatttgtgaattttccagttttacttctgtcactgattcctgttgtggtcagagaagatactttgtgtgatgtctatcttttaaaattgattgagacttattttgtggcctaacatatggtctatctaagagaatgtcttacatgtgcttgagatgaatgtttatgctgatgttgttgggtagcgtgttctttatatgttagatgtaattagtttattgtgttgtttatgtcctctatttctttaccttgtctggttgttctatctattattgaaagtggacagatgaagtctgctaccattgttgtagaactatatctttcttcaattctgttaagttttgcttcataaattttgagggtctattattaggtgtgtaaatatttgtaattgttttatcttcttgctatattgactattttattaatatataacataatgtttctgtctttgaaaacttttttgatttaaagtctattttgtcagctgttagtacagccactccagttctcttttggttactatttgcatggaatatctttttctattctttcccttttgatctatttgtgtctttgatctaaagtcagtctttcatagacagcatatagttggattctagagtttggtttttttttgtcaatctgccttttctttggacagtttaatctatttatatttaaagtaattactgataaagaggaatttctatttttctatttgttttctatatgccttatagtttttttgtacctcattttctctattactgccatcttttgtatttagcttattttttgtagtaaatgttttgattccctgatcatttccatttatgtatattttacaggtatttttgtgtttaccatgagaattacatttaacatcctaacgttataacaatctcattttaatttataccaacgtaacttcaatagcatacaaagactctgctcctatattgctccacccccaccctttctattgatgccacaaattacatctttatacattgtgtgcccaataatatactaatcttgtaaaaaattctttcttagctgtcctaagaggaaccaagggaggaagtgttcaaccctggaccagtgctttaaagcatcagcagaatgtcccttacatcagagtaatgtggcattgggcaaaccctaaagagcatggggcaaaccctaaagaatgtggataatcagaagaataaaatgtaggctatttgggcaaccacattgtctcacgtgaagatattccttccagaactgaactcctgatgtctctgagttttgttttacttaaagataagtccctctttcccaggggatagtctctgttttggtctgtcttcaactgtatgcagactgcaatttggggctagcacacagaaggcaacatgctcctgatccttgggagtgtgttcttgccgagtgcactcaaaaggaatacaaagatgaattataggagatccgagttccagagggactgtaagtttgtgtagctgctcacaaccaacttagcttaaagtgggatgtatggctctctcttattggtgactgggacattatgccttgtccctccagagcagcattttatgtgattcctttctgcttctctagtgcatctgtgtccaatacatgtttgctgaattaatgcattagttgggacatttgtagattccctacaacaatttactgctaggaggattatttgaacctaatacatatgcaaatatatatatttatacttttgcaaacatgatatgtataagtagttcctagaccagtgattttcagaccttgctactcatcagaatcacctgaggagccttcccaaaaccccgattcctacgtcccaaccacaaagattattttaatgagtctgaggtggaagccaggaatctacattttcaaaagctacccaggtaattctgatatgcagtcagcatagataaccacagccctttgactacctaagaaaatgtagtagtcaaaaaaaggtatatgaactgccttctattctttagggagattctatgttaatatagcatacggtcaagaacactaccaatgtagccacttcctagctgttatctttagacaaattacctaatcattcagagctttagtttcttgatgtgtaaaatagaggatataggtttaccatgaggatttatgtaaagccttagcacagtagctgtactatagcacacagtaaatgttggccggatttattcggctgtacacatgagccactggatttgtctggatgcagaagtctactgcggtacaccttcttcakcaagctcttgggaaagcaggggagatttcctggtaccctaggaagtggaggatactaaagccatgtcacagggaggggcattattcttcgtgcgcgcttgctcgccggggtcgggttgctgctccgcgcgcgtccaccaggggccgctcgagctacctaagctccgtgcgctacccggcggcgctcccgcgcgtgctcactcggagcagcgcgcgcccsgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggcygatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgaggtaaaccccgrgtgggtctgctctgcgtccgtcgagcytgctggaggggcggcttcgttccggttcggccttcctsggttccgaccgcggggacccgggcggaggcggggctggctgctgagctcgtgccacgcgctgttctcacgacggtgggggcggagggcgcgggagccggagctcctcagasccggcgggaccccaggcgcaccctggagctgcagacccccggccccgtcccacggctagctgaatcgtgagatcctggctcagggacgctcagctggtcagcagtcctattgggasctgtgacaacttagggcttctggctaccgaaactatcttcatttccacttaaaaagtatacgatttagctagaaacgaacgagttgtgaccgcagctttccacttttggtttatttgaattggtgtctcttcctggcgtctactgatacttggtcagggaatataaaattaatttwcttatccaasaaccgaaaaagsatataattatttttaaaaagtaatctgcttcaaggtcaagaacatgattttctaattaactgctgtttttggtttcatagtcacactttcttcatgggcccgaataattgaatagaccgtgtgtaatgaaatttacatttgaaatgtgaataaaataatttttgcagtcttggaaattttgaggtcccaaatttatttcgtatgccacacaagaactttcatgcgcgtccgtgtgaagagaccaccaaacaggctttgtgtgagcaataaaagcttttaatcacctgggtgcaggcgggctgagtccgaaaagagagtcagcgaagggagataggggtggggccgttttataggatttgggtaggtaaaggaaaattacagtcaaaggggagttgttctctggcgggcaggagtggggcaaggtgctcaggggagctttttgagccaggatgagccaggaaaaggacttttacaaggtaatgtcatcacttaaggcgaggaccggccattttcacttttgtggtggaatgtcatcagttaaggcggggcagggcattttcacttcttttgtgattcttcagttatttcaggccatctgggcgtatatgtgcaagtcaccggggatgcgatggcttagcttgggctcagaggcctgacaagaacagaatttgtgaattgcattttatttctcataagaagtatttgtttagattgttaaaagtaagaaattggattgttgagagtaggcagtcttctcaattttaacttccgcatgtctttgcagttgacggtattgtcwgtttttaaaaatttcttatttcagattaatcctaaatccttgagattgtggattattgaatagccrtatatggtatatacgacattttggataattctgttttaacctggttctttggttaatcatgttatttgcttaaccaggtctcccattcctggcaagttttcattggaggagaagcagtttatatagttttcaaatttctcaccacaatctcttctagaaggaagacagaataaatacaaaatcaatgctttgtggtggtggttttttttttggaaaacatttatgcatgttttaaatttatatatttcttcatataaatstaattgagttgtataactgctgtgaatttgtacattatcggaacctatgattgtccctaatttatgcaataactttgtatccaggcttctcgtttaagcagtggttctcaactggggtgatttttgccccgcaggagacatttggcaatgtctggagacatttttgattgtcatgccttgcagaggggcagttctattggcatctaatgtgtatagaccagggatgctgctcaatgtcctgtaatgcacaggacagttctcaacaacaaagaattatctgggctgggcgcggtggcttactcctgtaatcccagcactttgggaggccgaggcgggcgaatcacttgaggtcagkaattcaagaccagtctcgccaacgtggtgaaaacctgtctctactaaaaatacaaaaattagttgggcgtgtggtgcgaaaaaaaaaaattctctagcccaaaatgtcagcatcaagtttgagaaatccagagttgatttcatgccttcatttattcatttagcaagcatgyattgagtgcttgtaatggatgaggcactgtttcactattttatgtctttgatttgcagttttgtttctgccacattttaactgagaaacatgcattctaaaatgttgagttggattggcccattactttttttaaagtgaggtttaataggatacaatttacataaaataaaattcaccctttttgtaaatttattgtgatttgaaaatactaaaattcatgattygaatttgtggtaggagaagtgttttatgtggaactggcagttatttagttgataaaagaagaaataatatttagtagtagaacatgataccttaaggcttttaaaatcttgtgttctcagatgtataccatggagttatattccaatatggtcttacaaatcattttatctctttttttgtcttttgttttttgcttttttttttttttcaatacaagaaatctcctttacagacaataggtgaagaacaaacccagaatccctacactgaactgctagtactgaaggctcatcatgatattgtacgatttctggtacagttagatgactacaggtaagaagctatagtggtctaattgactattgtttgggaagaggttttagggaattttatgttaaacacctttaaaattaatacatcttttctaaaaatttaaaaactgtgatcattagtaacatttagtagaaattgaaattggcctctgcatctcgatgaaatatrtatctagagtcttttttgcccaaagtcagggtgtcgtgtctggtgatttgagggttatgtttgtttgtttgcattctcagaaatattcttaatagtttaaaagaagtgtatgactttaaaatttgggtaggagttataacagtatattaaggagaacttgtatttgagaaacaaatatgctaagtgtttaagtatcaggtacctaccaggaatgttttatttttagtggaaggtaagtttaatccaaagtttttgttattgatgaaaccacttgaaaatgtacattattctgtacttccttgctaacatgtataataattatgtttaatatatttgcaaatagaggtgaaggtgtataggctttaggactgtagactattactgatatgtatatatgtatattaagcccatattcaactgtatatcttttatagcatgtttcaccataataattacataattagtggtgtaattcaatattttcgtcctctctaaaatgtaagcttcatgagaatgaggctatgtttttcttattcaccatgttttcttagtacctagtacagtgccttacatgtagcagataattcatagatggtggctgagtgaatgaatgactctccagactactaagcatccacattgaatgccgtcctaatccccyaacctcatttctgttgtctctactagtttttccactttcatctctaattttgtcttttgcctttgctgttttttttcactccatggatgagtgttactgtaattattcctaactctgaccaccacttctgctgtctattaaccttgtcttttctctgcttttttttttttaatttaatttaatttttaaaatagagacagggtctcactatgttgcccaggctggtgggcaactcctgggctcaagctgtcttcccaccttggcctcccaaagtgttgggattacaggcatcagccaccgtgctcagccttctctctgctctttaaatgttactgatatttagttgctttaccatgtgcagtgcagttctgacattacctggacttaggtcagattccacagatgaagggcatagtctatacagcacccctcactggagacactagctgcaagccatgtatgggtttgtaggccacttgcatttccagctgctggctacaagttcctgctgttccctcaggtctgataattcactagaaggactcacagaactgaggaaagcactatacacaggattacagttttattataaaagatacaaattaggaccggccaaatgagaggatgtatatagggcaaggcctagggggtcccacatgcaaagcttccatgtctcaagactcctcgccctcttggaacatcagtgtgtatcaccaatgaatgagcacacttgagctttgggtgtccagagctttcattagtaggcatgattgtttgaatcattggtcacataattgaactcaatcttcagtccccaccctccccaccgtgactggtagcagaaagcccaaacctttaaatcatgtggttcatttttccaccttggccagcccctttcctgatgttatctcagggcccactgtgagttgttcctttagtataaacttaggtgtggtccaagggacccaccatgaataatgaagacattcttaccacttggaaaattccaaggatttagagactcccttctaggaaccagagacaaagtccagcaaagttattaaacagtaccatgcttcttaacttttgcttgaaaagatttgtctcatatatattactggcctgtcatcactgttttcctgttgtgatgcaagtcaaccaaatcatgscatgttaaacaatcatctgcagcctttttttkggcaatgttacttgttgctatgtcctgagagacactccatttattaaagtggtcatttttgtggggaactaattatttctggaaaggtaagattttggacagctaaagttttcttgcgctatattttaccctagtaagttgctagattaaagaaaatctgataatttcttataatcactaatacttgggtgttaaggaatcctaaagttattttgtccaggaaagttaaataataaatacacagtatgtgatcaggttgtggactttaaatatttgtataaattgttaagagatcatgttcattgctgtctttcctctgtgaaatatcctcttggctattcctatcccatagttagaagaggactctgtagaagaggccagcctatagaataatggttagtgtacaaatgctgacatatatttggtttaattttccccacagtggtgctcacatatactttagttgtttaatgatagagtaaatattctgtaaagagtaaaaagccatatgtgggtatgttagttaccgattgctctgtcagctgtcacaccaaacttagtggcttaacacaaccccatctatttakctcattattctgcaggatggcaattsgggctaggctcagctgggtgagtctgtctttgcaccaggagcaactgatcttggctagattcacttatgcctctgtcagctggtagattggcgggggctggctggttcatttcagctgaaggtctcagctgaaatgactgtggtctccctccatgtggtttttcaggtgcttgttcacataatgatcatggagttctaatagcagcagaagggcaagccccaaagtaagacacttttcaagtctcagcttgcctcgtgtttgctgctgtttcgtcagccaaagcaagttaggagctggcacaaattcagtgagtgggtaaataaacttgacctctcatggtagaagtaactaagtcctattgctaatggtggtggcaatattgggagggggaataayttgtggccagtttgtgatctaccacagtgagtctaagatagatgaagaagcctgctttttggcttttgtaatacagtgatgatatgacttcatgattcacatttaattctttgaaaagtcatcaaatttacatataatcaactatgaagtttttcggtcatttgctgacctgtagaactttcagtctgtatgttgtttttaaaaatttaattctgtagtgtactaaaaaagaaaaaccgaaagagtcatcttcgtaagaaggacacaggaaaatctacaaagtataaacattatgaacagaattaaccgaatgtttttactcttaatagtttagaattatctttaccattgcatatgtacattatgcattgtcaaattagagaaatacctttccagttttaaaattttatatcattatcctttttttgtttcttagtttttgaagacattacaytctgggttttttttggtcagctgttataatccaggtttcacgcttcaagtctttagataatawcatcttattgaaaattttgcagaaggattttcttgttttctcagtggctcagctaaaatcagtgagtggaaaattttctcggattggtttttgaagatacccaataaatcctgtataacctaacagacagctgccttttcttttcttctttagtattttttgaacatgaagtgagggtcgtattgatgagagatcactaaagaaggttaagcctcagcaaaagtcttccaaaaaatgggctgtgctaaaattkcatgtaatactctagcgtttgacacattaaactaaactgagttcataacacattttaagaagagttttctccgttgctcatttgaccattccttgctccttcaggaaacagacaaggttatgtaggatggtgatcatgactggaaargaatcagatgacccatgatgaagtgccagattggagaacaaaatgtgcctctaggatggttggtgaagctgtacattcacaagaaagtaaataaactcagtatagcttgataatccactaaaaatgaacaatatgctcattttaaaggaaatattctcaagctaaacatattctttcttatacactaaccttcagagaacagaaatcagtatagtttagatcctaggatctgggttccctgggaaacagatagtcagtatagatccttctagtacctgggttccctgggaaggagacactaaaatggagacactaagcatgcaataggtttataagagagaaagccaatgaaaggagaagggaggaagcagaattggataaggggagctgtctcagactctgatgcagatgtgacaaagtttctgccagcccaatggggaccgctggaggaaaggctgctttttaagagttctctactggatgtaaataactagggctttgtactattgccttgcttagttatttgctgagggtccttcatgaagaayatgcacctggcttctactatctkgcttaaatcccagtgactaggagccgattgagctagtataactttggcttgaaggcagaaatggatcctgaagtcaacagctggaggcagtcagataactatattcctcacagctgggcagtgagtcctgtcttgaaagggggtctggaaggcaggtattggcgtctgccacacttccatagttgtaagttggtctattttatttttaacttgcatgaacatactcatkggctatgtctttgggcagctttttaagraactgtaagtatgccattggttaatagttatttgatggcttgaaaaagttaatatttttagagctattaacgtacttatgcctggaaaaaagggtataaccagratcctttttatcacaaattccagcagctacaatattaataacagactccatatctggcatttttttaaagcacttatatccagtgtgacgttgactttagacaactttattatagtaaattttactaaaatctgttaaccaaatagcttttctwtttctaaaggcccctaatccaccatgtgtggtgaatgtgttgattgaatttctgttgttttgcatcgtgccctgaatcaagcggggaatttcggcagtgtcatcacacagatgcgtgtgccacccttgctgcttttctccttatttctaataattttgtcctttcagcttgtgttttggagctgtagctgagtttygtttagttggataagatgttgcagggtttgggaggatgacaggagtgagtgaaamggtaattgctgcttcatgcattagcatagaatcaaattttaggataaggacagcaagtgtctaacagtatttcagtttcaaatttgtcatcttagcagtaaaactctaatttctagataaaatcagtctctctcaactacaaaatacccttactctaggcatttgaaaattattttcttgaacatctttcaaatgtagctttaaaaatccatctggcaacttgagcatagatayaggaagtaactgcaatgaattgcaacatatcacatatgtttaaatccatgtgttcataatgatacttaaaaaagagaactcacctttggagaatgctggggaactaactcattctgttgaaaatcggtaaataaaagggcagagtcaaaatctrtactgcctttcttatataaactgtgtcttgggatcagtaataattgacgagaagaaatttctctgaagaattcaagctaggaagaatgatagaattagaatattgtaattttgcaacctctaatgtgtagaggaggaaaacacttttcttctacctatcttagattcattgatcagggctctacaacttagacatacaaaagacaggttaatgagcgaaaaagaagtatatcaatgcatacgttgcatacacacacacacacacacacacacacacacacacacacgagtattcargtaactcgtaggggtggttaaaacttgggcttaggctgggcacggtgactcagccctgtaatcctaacactttgggaggctgagatgggaggattccttgagctcaggagtttgaggctagcgtgggcaacatggcaaaaccatgtctctattaaaaaatacaaaaattagctgggtgtggtggtgcacacctgtggtccaagctacttgggaggctgaggtgggaggatcaccttagctcaggaggttgaggctgcagtgagctgtgatcggggccactgactgtagcctggatgactgagtaagaccctgtctcaaaaaagaaaaataaaacttcagcttatatagcatcttagcagaacaagaaatttgttgagtgacaagacaaaggaaatggactttgagtttcttggggtggcaaattgtgagaaggcaaatatatgatggaaactgctggtagagaagggctcattagtgaggttggtttgtgtaaactcttggtgccatctcatctgtgataaaggttgttatccccctcctggtatgggagtgggggtggaggttccgggggcactttcccaagggtgatgtgtgctttttttttttttttttcaggtagatgtggggaggacagagctcattctgtgcctgcattttctcagttgccttaagctgaaaataatcattatgtcagagtggcatagtttggggttatgtgctctgaaccccttcaaatgaaataatgaatttagatggcctaaatcataacatatacacatacacacacaagatagccagaaattatayttcckgatggagtatacaatctgcctttggggtggtcttaccaaaaagtcagatatggatcttatttagtctctagatttaactatcaattaacaaaaaatacagaggacagaggtgcatgttggataacagcacaggaaaaaaawcccagactgtgagaactcgacaagacaggtgaatttttttttcaacaaataaattrcaaggaaaaacagatggagaaaaaaatcattagaataaaagagatattagagataaatcaaccaagtgtactatagaagccttatttggatccttctaactgtttaaaaaattacgatcagctaaatttgatcattgactgrgtatttgatgacattaaggaagtaaatgttaacttagrtgtgatgtaaaagagtccttagagatgcattctgaaatactgacaaaatgaaatacagtgactaggatttgcttcaaaataatttacagaggggttggactgggtgcagataagacactagtggccataaattgataattactagagacaggcaatgagtacatgtggctttttattataatgcccttctctccacttttgtatatatttaaattctccgtaatgaaaagttaactatctgtatttgaaatagaggaaataaaaatgccaatttaaaaggtatttatgcctctgtgaaataaaatgttttcttagatattgctagtgttctgagtgttcagtggagaaccacccttgtttctctttgagaacagaatttattgagaatagttgtaggaatcatacagatgaacatgaacatatcagcttcataaagtaataaccgatacaaaactggattaccagatatggctcttttttttttttttttttttttgagacggagtctcgctctgtcgcccaggctggagtgcagtggtgtgaccttggytcactccaaccaccgcttcccaggttcaagcgattcttctgcctcagcctcccgagtagctgggactacaggcatgtgccaccacaccgagctaatttttgtatttttaatagagacagggtttcaccayattggccaggctggtctcgaactcctgatctcgtgttccgcctgcctcggcctcccaaagtgctgggattacaggtgtgagctaccaaacccagccaggatgtggctttaatatgtacccacagtggatttccttaacacttcaccctgagtcaagtagactatttcaatgaatccctggggcaactgaagagttgccagcctcccattcagatacaggcttacctcaaaaataagagcagaccagtatgttccctctctgtgaacagatgaatcttcagaaaacccacaaggggcygggtatgatggctcatgcctgtaatcccagaactttgggaggccaaggcgggtggatcacaaggtaaggagtttgagaccagcctgcccaacatggtgaaactccatctctactaaacatacaaaaatcagccatgcgtggtcgtgggtgcctgtaatcccagctgaggcaggagaatcgttagaacctgagaggcagaagttgcagtgagctgagatcacgccattgcactccagcctgggcaacagggcgagactttgtctcaaaaaaaaaaacaacccagaaaacccacaagggtctgaactgagcatgcctaattcattgtctcaagcaagtggsgcagagagagaccaagaatgtttctctagtagtrggagtcctccatggaaacttgagtgcaggggaatggaggttcacctaatagaagtcacacagakttttttggtattctaatactgtaatctttttttttttttttaattatactttaagttttagggtacatgtgcacaatgtgcaggttagttacatatgtatacatgtgccatgctggtgcgctgcacccactaactcgtcatctagcattaggtatatctcccagtgctatccctcccccctccccgcaccctacaacagtccccagagtgtgatgttccccttcctgtgtccatgtgttctcattgttcagttcccacctatgagtgagaatatgtggtgtttggttttttgttcttgcaatagtttactgagcatgatgttttccaatttcatccatgtccctacaaaggacatgaactcatcattttttatggctgcatagtattccatggtgtatatgtgccacattttcttaatccagtctatcattgttggacatttgggttggttccaagtccttgctattgtgaatagtgccgcrataaacatacgtatgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaagagtgtaaaagtgtttctatttccccacagcctctccagcacctgttgtttcctgactttttaatgatcgccattctaactggtgtgagatgatatctcattgtggttttgatttgcatttctctgatggccagtgatggtgagcattttttcatgtgttttttggctgcataaatgtcttcttttgagaagtgtctgttcatgtccttcgcccactttttgatgtggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgtagccattgcttttggtgttttagacatgaagtcctygcccatgcctatgtcctgaatggtaatggttaggttttcttctrgggtttttatggttttaggtctaacgtttatgtctttaatccatcttgaattgatttttgtataaggtgtaaggaagggatccagtttcagctttctccatatggctagccagttttcccagcaccatttattaaatagggaatcgtttccccatttcttgtttttgtcaggtttgtcaaagatcagatagttgtagatatgcggcrttatttctgagggctctgttcttttccattgatctatatctctgttttggtacsagtaccatgctgttttggttactgtagccttgtagtatagtttgaagtcaggtagtgtgatgcctccagctttgctcttttggcttaggattgacttggtgatgcgggctcttttttggttccatatgaactttaaagtagttttttccaattctgtgaagaaagtcattggtagcttgatggggatggcactgaatctataaattaccttgggcagtatggccattttcacgrtactgattcttcctacccatgagcatggaatgttcttccatttgtttgtatcctcttttatttcattgagcagtggtttgtagttctccttgaagaggtccttcccatcccttgtaagttggattcctaggtattttattctctttgaagcaattgtgaatgggagttcactcatgatttggctctctgtttgttgttggtgtataagaatgcttgtgatttttgcacattgattttgtatcctgagactttgctgaagttgcttatcagcttaaggagattttgggctgagacagtggggttttctagatatacaatcatgtcatctacaaacagggacagtttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatccatacctaatttattgagaatttttagcatgaagtgttgttgaattttgtcaaaggccttttctgcatctgttgagataatcatgtggtttttgtctttggttctgtttatatgatggattacatttattgatttgcgtatattgaaccagccttgcatcccagtgatgaagcccacttgatcatggtggataagctttttgatgtgctgcyggattcggtttgccattattttattgaggatttttgcatcagtgttcatcaaggatattggtctaaaattctctttttcggttatgtctctgcccggctttggtatcaggatgatgctggcctcataaaatgagttagggaggattccctcttttactattgattggaatagtttcagaaggaattgtaccagttcctccttgtaccactggtagaattcggctgtgaatccatctggtcctggactctttttggttggtaaactattgattattgmcacaatttcagatcctgttattggtctattcagagattgaacttcttcctggtttagtcttgggagggtgtatgtgtcgaggaatttatccatttcttctagattttctagtttatttgcgtagaggtgtctgtaatattctctgatggtagtttgtatttctgtgggatcagtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatgtccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattcttgttctcgttggtttcaaagaacatctttatttctgccttcatttcgttatgtacccagtagtcattcaggagtaggttgttcagtttccatgtagttgagcggttttgagtgagtttcttaatcctgagttctagtttgattgcactgtggtctgagagacagtttgttgtaatttctgttcttttacatttgctgaggagtgctttacttccaactatgtggtcaattttggaataggtgtggtgtggtgctgaaaacaatgtatattctgttgatttggggtggagagttctgtagatgtctattaggtctgcttggtgcagagctgatttcaattcctgggtatccttgttggctttctgtctcgttgatctgtctaatgttgacagtggggtgttaaagtctcccattattattgtgtgggagtctaagtctctttgtaggtcactcaggacttgctttattcatctgggtgctcctgtattgggtgcatatatatttaggatagttagctcttcttgttgaattgatccctttaccatgatgtaatggccttctttatctcttttgatctttgttggtttaaagtctgttttatcagagagtaggattgcaacccctgcctttttttgttttccatttgcttggtagatcttcctccatctttttattttgagcctatgtgtgtctctgcacgtgagatggrtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagttgatgcagtttcttcctagtctcgatggtctttacattttggcatgattttgcagcrgctggtactggttgttcctttccatgtttagcacttccttcaggagctcttttagagcaggcctggtggtgacagaatctctcagcatttgcttgtctgtaaagtattttatttctccttcacttatgaagcttagtttggctggatatgaaattctgggttgaaaattcttttctttaagaatgttgaatattggcccccactgtcttctggcttgtagagtttctgccaggagatccgctgtgagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctgtataatatcctgcagagtgttttccagtttggttccattcttcctgtcactttcagttacaccagtcagacgtagatttggtcttttcacatagtcccatatttcttggaggctttggtcatttctttttatttttttttctctaaacttcccttctcgcttcatttcattcatttcatcttccatcgctgataccctttcttccagttgatcgcatcggcttctgaggcttctgcattcttcatgtagttctggagccttggttttcagctccatcagctcctttaagcacttctctgtattggttattctagttatacattcttctaaattttttttcaaagttttcaacttctttgcctttggtttgaatgtcctcccgtagctcatagtaatttcatcgtctgaagccttcttctctcagcttgtcaaagtcattctccatccagctttgttccgttgctggtgaggaactgcgttcctttggaggaggagaggcgctctgctttttagagtttccagtttttctgctctgttttttccccatctttgtggttttgtctagttttggtctttgatgatggtgatgtacagatgggtttttggtgtggatgtcctttgtgtttgttagttttccttctaacagacaggaccctcagctgcaggtctgttggagtacccggccgtgtgaggtgtcagtctctcccttctggggggtgcctcccagttaggctgctcgggggtcaggggtcagggacccacttgaggaggcagtctgcccgttgtcagatctccagctgcgtgctgggagaaccactgctctcttcaaagctatcagacagggacatttaagtctgcagaggttactgctgtctttttgtttgtctgtgccctgcccccagaggtggagcctacagaggcaggcaggcaggcctccttgagctgtggtgggctccacccagttggagctttctggctgctgtgtttacctaagcaagtctgggcaatggcgggcgcccctcccccagcctggctgctgccttgcagtttgatctcagactgctgtgctagcaattagcgagactcygtgggcgtaggaccctccaagtgaggtgcaggatataatctcctggtgcgccgttttttaagcccgtcggaaaagcgcagtattagggtgggagtgacccgattttccaggtgccgtctgtcacccctttctttgactaggaaagggaactccctgaccccttgagcttcccgagtgaggcaatgcgtcgccctgcttcggctcgcgcacggtgcaygcacccactgacctgcgcccactgtctggcactccctagtgagacgaacccggtacctcagatggaaatgcagaaatcacccgtcttctgcgtcgctcacgctgggagctgtagaccsgagctgttcctattsggccatcttggctcctcctcctactgtaatcttgatgtgtagtttagctttctatctgtgatttgggaagggaagaacttaccaaatgttttacctttgcaaataaccatgggaactatgcaatctttgtttgtgagctaaaaaaggaccttagacttttagatgttagagtcatgttaatataatacattcttttttaaggaaaagaaattgttgaagtagatctaattaaggaattggttgcgtcagcatctatggctcctgaaaatgctttgacgtttccttcaactsctttacaagtccctatctggatgcttctctaattttcttcaagtagttctagcatacaaacatatactttaaatgaaaattgtgattttttttgttgttatactttaagttttagggtacatgtgcacaatgtgcaggttagttacatatgtgtacatgtgccatgttggtgtgctgcacccagtaactcatcattttaacattagttatatctccaaatgctatccctccccactccccccaccccacaacaggccctggtgtgtgatgttctccttcctgggtccatgtgttctcattgttcagttcccacctatgagtgagaacatgcggtgtttggttttttgtccttgccatagtttgctgagaatgatggtttccagcttcatccatgtccctacaaaggacatgaactcatcatgttttatggctgcatagtattccatggtgtatatgtgccacattttcttaatccagtctatcattgttggacatttggkttggttccaagtctttgctattgtgaacagtgccrcaataaacacacgtgtgcatgtgtctttatagcagcatgatttataatcctttgggtatatacccagtaatgggattgctgggtcaaatggtatttctagttctagatccctgaggaatcgccacactgacttccacaatggttgaagtcccaccaacagtgtaaaagtgttcctgtttctccacatcctctccagcatctgttgtttcctgactttttaatgatcgccattctaactggtgtgagatggtatatcattgtggttttgatttgcatttctctgatggccagtgatgatgcrcattttctcatgtgtcttttggctgcataaatatcttcttttgagaagtgtctgttcatatcctttacccacttgttgatagggttgtttatttttttcttgtaaatttgttggagttcattgtagattctggatattagccctttgtcagatgagtagattacaaaaattttctcccattctgtaggttgcctgttcactctgatggtagtttcttttgctttgcagaagctctttagtttaattagatcccatttgtcaattttggcttttgtagccattgcttttggtgttttagacatgaagtccttgctcatgcctatgtcctgaatggtattgcctaggttttcttctagggtttttatggttttaggtctaacatttaagtgtttaacccatcttgaattaatttttgtagaaggtgtaaggaagggatccagtttcagctttctgcatatgactagccagttttcccagcaccatttattaaatagggaatcctttccccatttcttgtttttgtcaggtttgtcaaagatcagatggktgtagatatgcggcgttatttctgagggctctgttctattccattggtctatatctctgtttttggtaccagtatcatgctgttttggtaccagtatcatgctgttttggttactgtagccttgtagtataatttgaagtcaggtagcctgatacctccagcttggttcttttggcttaggactgacttggcaatgcgggctgttttttggttccatatgaacgtgaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcccatcccttgtaagttggattcctaggtattttattctctttgaagcarttgtgaatgggagttcactcatgatttggctctctgtctgttattggtgtaaaagaatgcttgtgatttttgcacattgattttgtatcctgagactttgctgaagttgcctatcagcttaaggaggttttgggctgagacartggggttttctagatatacaatcatgtcatctgcaaacagggacaatttgacttcctcttttcctaattgaataccctttatttccttctyctgcctaattgccctggccagaacttccaacactatgttgaataggagtggtgagagaggkcatccctgtcttgtgccagttttcraagggaatgcttccagtttttgcccattcagtatgatattggctgtgggtttgtcacagatagctcttattagtttgagatatgtcccatccatacctaatttattgagagtttttagcatgaagagttgttgaattttgtcaaaggccttttctgcatctgttgagataatcatatggtttttgtctttggttctgtttatatgctgaattatgtttattgatttgcgtatattgaaccagccttgcatcccagtgatgaagcccacttgatcatggtggataagctttttgatgtgctgctggattcggtttgccagtattttactgaggatttctgcatcaatgttcatcagggttattggtctaaaattctcttttttggttatgtctctgcccggctttggtatcaggatgatgctggcctcatgagttaaggaggattccctctttttctgttgattggagtagtttcagaaggaatkgtaccagcttctccttgtacctctggtagaattcggctgtgaatccatctggtcctggatttttttttggttggtaagctattaattattgcgtcaatttcagatcctgttatyggtctattcagagrttcagcttcttcctggtttagtcttgggagggtgtatgtgtcaaggaacttatccatttcttctagattttctagtttatttgcrtagaggtgtttttagtattctctgatggtagtttgtatttctgtgggattggtggtgatatcccctttatcattttttattgcgtctatttgattcttctctcttttcttctttattagtcttactagcgttctatcaattttgttgatcttttcamaaaaccggttccgggattcattaattttttgaagggttttttgtgtctctatttccttcagttctgctctgatcttagttatttcttgccttctgctggctttcgaatgtgtttgctcttgcttttctagttcttttaattgtgatgttagggtgtcaattttagatctttcctgctttctcttgtgggcatttagtgctataaatttccctctacacactgctttgaatgtgtcctagagattctggtatgttgtgtctttgttcttgttggtttcaaagaacatctttatttctgccttcactttgttatgtacccagtagtcattcaggagcaggttgttcagtttccatgtagttgaacggttttgagtgagtttcttaatcctgagttctagtttgattgcactgtggtctgagagacattttgttataatttctgttcttttacatttgctgaggagtgctttacttccaactatgtggtcaatattgaaataagtgtggtgtgatgctgagaagaatgtatattctgttgatttggggtggagagttctgtagatgtctattaggtctgcttggtgcagagctaagttcaattcctggatatccttgttaactttctgtcttgttgatctgtctaatgttgacagtagggtgttaaagtctcccattattattgtgtgggagtctaagtctctttctaggtctctaaggacttgctttattcatctgggtgctcctgtattgggtgcatatatatttaggatagttagctcttcttgtgaattgatccctttaccatgatgtaatggccttctttgtctcttttgatctttgttggtttaaagtctgttttatcagagagtaggattgcaacccctgcctttttttgttttccatttgcttggtagatcttcctctatccctttattttgagcctatgtgtgtctccgtgcatgagatgggtttcctgaatacagcacactgatgggtcttgactctttatccaatttgccagtctgtgtcttttaattggagcatttagccyatttacatttaaggttaatattgttatgtgtgaatttgatcctgtcattatgatgttagctggttattttgcttgttagttgatgcagtttcttcctagcctcgatggtctttacaatttggcatgtttttgcagtggctggtatcggttgttcctttccatgtttagtgcttccttcaggagctcttttaagacaggcctggtggtgacaaaatctctcagcatttgcttgtctgtaaagtattttatttctccttcacttatgaagcttagtttggctggatatgaaattctgggttgaaaattcttttctttaagaatgttgaatattggcccccattatcttctggcttgtagagtttctgccaagagatctgctgttagtctgatgggcttcccttygwgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggagaagttctcctgtataatatcctgcagagtgttttccaacttggttccattctccctgtcactttcagttacaccaatcagacgtagatttggtcttttcacatagtcccatatttcttggaggctttgtttctttttatcctttttttctctaaatttctcttctcacttcatttcattcatttgatcttccatcactgatacccttagcattttttcaatgttattttattgtaaatgtaataatgacttcaggcagtgattattgatgggtgttaacatcacacacacgcaaaaatgactgccagaaatttgtttcctaatggagtatacaaactgcttatgaaatggtcttaccaaagagtcagatttgaattggattaagtctgtagatttaaggatcagttttctaaaaatacagaatacagaggtgcatgttagatgacaacagaggaaagtagtcagcaaaatctgggctgtgagaattatacaggagagacaactagggtacatgtgcacaacatgcaggtttgttacatatgtatacatgtgccgtgttggtgtgctgcaccgattaactcatcatttacaktaggtatgtctcctaatgctatccctcccccctacccccaccccacgacaggccctggtgtgtgatgttccccttcctgtgtccaagtgttctcattcttcagttcccacctatgagtgagaacatgtggtgtttggttttttgtccttggcgatagtttgctgagaatgatggtttccagtttcatccatgtccctacaaaggacgtgaactcatccctttttatggctgcatagtattccatggtgtatatgtgccacattttcttaatccagtctatcattgatagacatttgggttgaagagagacaacttttttcaacaaaaagattgcaaggaagaaaaagatggagaacaaaaccatagaaaaaagagactttagagatatatcaagcagttgtgctatatagaccttatttagatcctgcgtcttactgtacaaaaaaaatgatgagatgatcatggaaactgtatagtattttagttttatcatgcattagaaagtacttgcaggttaggtggaaagttaaccactggggtgcctgtactgccataataatgtcgtattaagatttttattttttcagtgccttatgtagacattgaatacaggaagatttatggttcaggtttatggactatactttttatgtcctttaaggtaacatttgaatttttgggaccttcacttagttgaarggccttcwcatgagtaagaactattaaatgagcatttagctattggacataagaattattgtgaaaacaatttattttttacaaatctttattaagctttgcygtagttttcagcccactgttggaaggaacgagagaatactttctcagagatgttcaaagagaagatgtttagagggaattatttttatacattaagatggttgtaagtgagaattctctaaggactcatgatctagaccctatagcatcacatggtaatgttggactgtgagttcttgaatggcaagaacaatctcttgatctttattcttaggtttaagcatctatatagttagtgcttagtaagtattgaattaccgagtgacttatggactatcataataaatttagttctcataattaggggatgagaggatgaaacattctaggaggtctgccataggtctttgttaaaccatgtttcaccttgttgaacttgtttttcatgaatrtaagttttgcttagtcatttaattgtgtagtctcaaggagtatttttaacaacttgggttttttttgttttttgtgttttttttgagatggagtcttgctctgttgtccaggctggagagtggtgtgatcttggacttggttttaagttaaagaaaaaacctgaagtatatggataagaattggacaggaatatgaaaaaatatagaaatttatttttgtgtggtagggattctgggttttaaatttttaagtttctattttttgtggtagtatatttacattaattatgataaaaggaaaatatggggttacattgccatcattaatcaatctatttcacagagcccttgaacacttaaatgtttgcttatgcattcacttattcattcaacaagcatttctttagcacttaaaacctgccagagataatcagagattcattagactggcaagtgccatgttataaagataaagatcaataaatatggtaattcttagagttcatgattctaagaagcatatttttttctattttgacatctctaaaatttggacacatcatataattgtgtgtttcaattgtaattggcartatgttttccttaatggtaaataaaataagagtgtcttacaattgatgtcttagatttgatgaaatacggtacatttctaaacaatcataaagttttaagatctcaaagcaagaaccacatgtaaggtgtcttcacatttccctaactcctagcacggaatcacactgaatacattttttgctaatcggtaaagaaacatttctctcaaaatcttatctttaggcttaagtttttgctttctgttactttagaatgtttttaaaaattagtatgtaaaatgttatctggcaatattactattcttccattggatagaatagcttaaactttattgacattttaatcctttttttattttatagttcattacttcttttcagcagttacactataccttacaattaggaattcttgggttgtatttccatttctgatttggagatggttgaagtgtatgcttgactgactaggatttagtttaagataaactgataaagtatagctagttttttgttatccatsataataggatgggtaattgtaatttgtgaatgatatctcaaccctttattagtttttttatgacaggtactaatatgtgtcaaagttatactggtttgtattttaaagcttaatgtttcctctttaggggaggtagtaataaatactgaaatggcaaaaaaaaaaaaaaaatggtagcaatagaatatatataagaatagaaggcctgaataatctaccaaccaggtaattgaccttgcagcaataaaaaattgactgtgatttcatgcattactattgagccttatttagatttaacttttgttccctactgattgaattaaagtttgaggttaaatgctctatatcccatttctaaactctcagctgttctcagtcatctctcattgtgaactcatgaaagtcaaacatgataaaacaatcataagaagttaaaaattagggttagaaaaaragtatgtattttaaacttgctgtcttctaaatgcaattttaagtttaaagaatcaatagaaattgatgttttataccaaagaacacttaagaccttgagtcctgccctcyccaccatcactatacaaataaaaagaaatcaataggcccagaaacataagctgctaaagatttatttccagcaactatttttgatattcaaggtactatttactaatctgattgagaaaatgtagataattaagcataggaaatctatttttattttaaaaatgatcattttctttttaatctccggatcttttatatgttacattttaaaataagaataaatgataggcatggatttaaaaataactctttgtgatttttagctagttacctaaatttaacaggtccattctgttaaaaagataggtagttctgtatttaaaaattattaaaagactgtcagactgtatttgatcaatttcatgtctcctgaataatcttggttctaccagtagtagatgtactcaaaggattttgaaataagaactgagtattggaattgtctgagccagtgaaggcactgaactttgaaactgaagataagaaatttgaacatgaaactcagtttggagtgttaaggaaagtatttcatgactgaaatagtgggattttgttatctcataaaggggtaaaaaatccattagaacagatgctcacatagcatctgttaattataaggggccagttatatgtcattcatagctggctctctttaacaccacttctttctctcatactgaaaaaaaaaaaagcctgaatttgagtgaaagcaatattatggggacaactttaaattgattctgagtcattaaaaattatttacaaacttgtggatgacattaacagtaaattatttgacatgcttatgatgtgattatttatactactttgttgsgttagtataataagatggtgaattttagtataatatggtgatgaataatcctgtatgacaggttattccttttgatagtgtttatgttcagaatatcttctactctacagaatttggtgattgtccctgtgatatggtgaatgggatataaaaaggagagagaagctatagcagactatcacagctcatttttcatgccataagacaagctttacctgtgcatttcaagcatcttcactaaaaagcaacaaaaaaaccctaaaaaatcctcaaatcttccaaaccaagaacaaagcatttatgtggaaagactaaggagttgagctgagcaaaagagagatcttgactttaaataataattatttacagagagaataatagaagtaatgaatttatttaacatcgtaatcacttcctagaatatcacttcctgtcactgaaggcacttgtcagcttggtttcatttcacttaagtcagggatttcttaaaatcatagaattttaaagcaaagaaggactttaaagattatttttacatttctagcagtttattctttgtaaacttataaatgtcttatttatcttttgatcttccatacctggtacagaagctggaatgtgtttcataaatattttttaaattagctgaaataacttgatcttcgttaatattagtcaaaataccactaataaggtttgatagttcttaatcttagtaattaaatgtcaccagtgatttttttttcttgaccctttctccctaaccagatttgcatctgctgrtgatgatggaattgtagttgtgtggaatgcccaggtgtgtattgattatgtgtggattgtgtgataaagatatgatgatgtagttgagtatgtattcatataaatactatctggggatacatttrcatatcactgttaattgacacattaatatttgaaaagagctaattaggataaatccatatacagtggggaccagtatttcataatgaagagggaaagtttttttaaattgagattttttttccagctgggtgtggtggctcgtgcctgtaatcccaggactttgggaggccaaggcgaacggataacttggggccaggagtttgagaacagcttggccaacatagcaagaccccgtctctactaaaaatactagaaatcagctgggcatagtggcacatgcctgtaatcccagttactcgggagactgaggttgcagtgagccgagaacatgccactgcactccagcctgggtgacacagcaagactgtctcaaaaaaaaaaaaaaaaaaaaaaagttttttcctaagaaacaartgccaaagtatgaaaattcaaaaaatacaaaattttaatcttatttaacaaaatttaggttatcactagctatgccctgacttccaaaatgaataaatgaattgtgttgatttttgtgagacacacaagttttctttcaacattgcgtaatagcataatgtaacatttttctcatgtttgacttaatattacaaaagccttttttttttaaataaatacttaaggcttcaccagtttcttcagagcctcccttcctgatcatttgttactcaaattattcttttttgaagtatcttcctctcaccttaattttggattgttatctagtctgactgtgtcasatctttatttttcaatggctttgcctgtgataaaatcagttctttaacattattttcaccacattcacgaagtcctgcaatcttggaaagatttgccatttacattgtatttttgcatgtttmctacttggtaaattagtcagagactgatggatgaagacaytggatgggtaggaatagatgttggtgttaaataacgatggagtggagactgactttctaagtggttaataaatgwgtggatatatatacttatttgtgtgtaggtacatatacagttgttatggtgacttttattttcttctatgaccttataactgtggagacttaaataacaaatacttggacaatgaggactccatatttttttcctgcaaactaagttactgatgtttttatgcttaatttacacaattatatttttaaatttatagaaaaaaatactcaaaattttctataaaaatatactaaaaattagcattttgttttagaaaataaaactatarttatggctgtactttcagtgcttgtttagattctgtgtgattgcttaagttaaattctgaataagtaattttaaatggaatgtatatgtatcttctatatggtagttgtacttaatgtagtcatttatgattatctaaattgtgaaagctaagcctattaacatttttattggtatttcagacaggggaaaaacttttagaactgaatggacacactcaaaagataacagctattattacatttccttccttggaatcttgtgaagagaaaaatcaactcatcttgacagcctctgctgatagaacagttattgtatcctttaatctggaagaaatgaacaagctgtagtggcctaaggagccactacatacactattagtctttagctgatagggtcttgtctgtatattcttgttatagcaaaaatgrtttttgttctgttacttataagataccatttattaggtatctgaaaagtattagactggaaataggaggttaaggcttgttattgatggaaactccrtgactattgctgttctttccagagttactctatcaggttgtataaaattgatgaaatgggaaaatgtggacttaaaaataatttattttactatctcagtttgcttttcaatttagggaaacaacgatgagttggactggagaataatttacattytttttccccactatacagcagaagaaaccaaatggtcccaacccataaaaatctttggagcatctgagtctgatagaaaagtgaattactgtttgttcagtgtgtaatatttaataattaaaaacaattttataaaagtaaaattactttttctttacccatacttttaggtaaaaagttaagatgggatagcagtagtaaagtgcttatgtgtaacaggcattgttctaattgttttacatatattaactcatttaatctttaaaattagccctttgacataggtatttttaattctttttttttttttttttttgagacggagtttcactcttattgcccaggctggagtgcaatggcgtgatctttactcactgcaacctctgcctcctgggttcaagcgattctcctgcttcagactcccgagtagctgggattacaggcctgtgccaccacgcccagctaattttgtatttttagtagagatggggtttcactctgttggtcaggctggtctcgaactcctgaccttaggtgatccacccaccctggcctcccacaatgctgggattataggcatgagccactgcgcccggccttatttttaattattcttatttacagatgaaaaaaatagagtcacacagaggctaagtaactttcccaaggcacacagccagtgtagggcagaactggcaagtctgactgcagagtcagagccccgaaccactgcacttcataaaatgttttctgtaaacaaactcagccctttaatatctgtatgaggaattggcttggtgaagtccagagtcaagtgctatggataactgttgtctttcattacttttatttttttaaaagaggttgtcagattgatttttttttttttttagacagaatctcactgttgcccaagctggagtgcagtagcacaatctcggctcactgcagcctccacctcccaggttcaagtgattcttctgcctcagccacccaagtagctgggactacaggcgcctgccaccacgtccggctaatttttttgtatttttagtagagacggggtttcaccatattggccaggctggcctcgaactcctgacttcgtgatctgcccgccttggcatcccaaagtgctgggattactggcatgagccactgtttccggtcatattaatttttaaaagtatatgcttatctgaaagttctgtktaaacastttcaagcattggtgaagttttggagtaagcccaaaagtataggtgtttcttaggctcttacagaaccaagatacagacttgaacatgctttaaatgagttcatcaactgaagtgctttctagacagattgttcatagctgaaaaaatgtcaagaaaaggtttaaatggggataaactctctatacatacatacatatatacatacacacatatatgtatgtttgtgtgtgattatgatacartgtaaacaagggcataaaattctctcagatggttaggtcagagttgctttattactactctgtagaggcaaatatgggataaagctctctttttcagtatcagtgtaatcttygcaaaaatagaatttaaaatactctattagaccactcctaagacactatagcaatattttgaggcagtgattaaaattacatacagaagttagtagctggtacagtgtcactatgaattttacctgtaaatgatagtatggactcatttcctttgctgagtgatttttgttgttagaaaaaaattctaggccgcttatttggcagtctctcttacccaaatgaattctaaatttactctgcttgggtttttactacaggttgagcatccctaatctgaaaatccaaaatctgaaatgctccaaaatccaagaccttttaagcactgacgtgatgccacaagtggaaaatcttatacctgacatcatgtgacaggttgcagtcaaaattttgtttaacgcacaaaattaccaaaaatattgtataaaactaccttcaggctatatgtataaggtgtatatgaaaaataaatgaattttgtgtttagacttgggttcagtccccaagatagctcattaggtatatgcacatattccaaaatccaaaaaaaatcagaaacacttctggtcttaagcattttggataagggatacccaacctgtaaaaactaacttccttaattaaatactgaaggtagataattttttaaagcgatagccttaggagctcaggttactgaatattaaatgttctgcttgtgaatagtgaaataagtgaaaaggctgtgagatactactagaattctggtaaatataaggccagaaaacatttcctaattactgggagcattttttgtatgctagcagttttagtgtgttatatacataaaatgtaattctcatgataatctagctccatctaaagcatgacatagaatatagatggtccccaacctagggtggtttgacttacagtttttcaactttatgatggtgtgaaagggaggtgcattaagtagaaactgtactttgaattttgaagtctgatattttctcacactagtgatgcatgggatgatagtctttcccagtgctgggcagcagcagcctggagctgcagctccttcctagtcagctataagatcacaagggtaaacagccttactctacagtgtactgtgttgccagatgacttttttttttgcccaactataggcttatgtaagtgttctgagcacatataagttaggccaggctaagctatgatgtttgatagatgtgttaaatgcattttgacttaggatattttccacttagaatgggtttattgtgggacataactactttaagtcaaggcacatctgtataataaaaatataacaaaaggcattggccatgataaggttaactagtttrtgaaattagtttcaatttttaatacatgcatatacatttgtatacgtagtacatacatgtatgtaaatgtgttttcagacatggtgtaaaatgtatttcttactataggaaatggtgtaaaagtttgaaaatcactgtgcttaagtcaaactgaacttggatgttttatgagaggccctctgattatattaaatgcacatacaggtaatagtaatacactgttagtgtcttctcgaatcaagataacagtagtaaatcatgctatccatattatagggagctttcagtaaatattaatggacatgatagtttttggtataagtactttatgcttattagattatggtgggctattctggagaataaactttaaacagttggaatatttagtgcttgtaaagattcagtacttcagaccattcattatgttggcattttcaaataatttgatagtaaaatttacctcaaacttattttagattataagcctgctttgctaagttgatgactcactatatgaattcatttttgtggtggtataaacactaaatattttatgtttgatttaaagattttctaactgcttaacatttgtggcttaattgttaattagaaaagttataattaagattttaaaattctgtttagaaattatttcttaacataaatttaggtgtgggatggtgatactaccagacaagttcagagaatatcatgcttccagtctactgtaaaggtaaaatcttaagtaaatatgagtttttatgacaatctatttttgtcycagaagacatggtttaaagagttagacgaaattacttttgtgggtcttatgaattatttctttccacacacttgtagtcatttgcttcgtgtaagatcagatttttgagagcacatgtattaagtgttagaatgtttcmatttgaaattagagcaagggataatcccaatagcaagataaggaaaaaaggtagtacctggtatgttttttgtaggtagttccaggaagagatattacttgtagaatgaccataatagtagctggtctgttttctttatactttgaatttaaaatatagagctatttgtcccatgacctttgccttctctaaggtcacaaaggcaagacatgtcagttacttagtttcaaaactaaaaatcttacctggctaatttgctgttactgttaggtttattccttttacaaacaattattaattggggctaatgatatgacagaagctctgctacgttttagagaaacaaacatagataagacttggttgcttgtgattcctacagaaattaagtgttcagagaaagtgccactgttttttagtaatgtaagcaagttttggaaaagatagtagtagcagtagatgttccctcatttactttaaggataactgatctccrtattggagctcttttcttttttttcttaatgtaaaaagaattgctgtgtgccaataggtagaatagttgatcttttcccaaaaaggcagaatctctggtagccatctcatggcactgtgctgttcaaaatatcaacttagtcaagtttcaggggaagaaagtgccatgtactatatatacttytatctaacttaacagtggattttttaagaaggcattaaaaagtattgatttgattaaaatctctatactttatgtgacctgaaatgatgtgccttttacattcctttaaaaatattcttgctayctgaaaaactaaggtcgttaagtttccaatgaaaatatgtggcttgaaggaacaaagagaaaaaaatttaatgtatttgggggaaattccttttggtaaactgtgttatgaactggttataggaactggtcactaaaaaagtatcttattccaatatagtgaaagtagttttaaaaggggttttactgtaatgtgaatcagctagatatttgtgtctgttttctcctgctgtgatcctgtttcacataaaaattgttaaaaaatagcattgcactcatttagttcagtggttcagttgttcttgaatagatagtttatccaagaaatttatatccctaatatgagaaatactatcatttattttttgaactaacaaaattttttataagggttgatgttagcaaggagatagtgaaattggcattttattgcatattgagactataaattgatatgatcttcccggaaggtagtttggcattatgaatgaatctaaataaattattatatgcattaatccagtgatcattctagaaaactctttaaaggaaatgatcagaaaatagggcagaaatttatgaacagaaatgtgtactacaaatacatttttataaatggatgattggaagtgccctaaatgtcttataagaaaatacattatggtagatatatatactaaaatttatatttcagaagaatattaaaagaggaaaatgctagtggtaaaatgttaagtaacaaaaacatatattatcctcaacaaaatattatcaaaccaaattcagcaacatctaaaaagaattatacaccatgactaagtgagatttatccctggaataagcttagtttaacatctgaaaattcatcagtgaaatacaccatagtaagaataaaggacaaaaaccacaggatcatctcaacagaaacagagaaggcatttgacaaactccaacaccctttcatgataaaaatactcaacaaactaggaatagatgagaatttcctcaacctaataaagggcttctgtgaaaatctcaaggctaatttcgtattaatggtgaaaggctaggctgggtgtggtagttcatgcctgcaatcccagcgctttgggagaccaaggtgggtggattgcttgagctcaggagttcaagaccagcctgagcaacatggtgaaacttctctacaaaaaaaaagaaagaagaattagccaggtctggtggcacatgtctgtaatcccagttatttgggaggctgaggtggaaggatcacttgagtccaggagttcgaggctgcagtgagttgtaattgtgccactgcactctagcctgggcgatagagcaagaccctgtckcaaaaaaaataataaaataaaaattttwaaaaatggtgaaagacaaataatttcccccaaagatcaggcacaagataaggatgtctgctgtcagcacatctgtttaacattgtactggaggttctagccagggcagttggacaataaaaaagataaatgacatccatattggaaaggaagacataaaactgtctctattcccaaataacatgatcttgtgtatatagaaaatcctaagtccacaaccaaactattgaggctagtaaatggatttagcaaggtttcaggatataatrtcaacacacagaaatcaattgtatttctattcactagcaatgaacattccaaaaattaagaaacaattccatttacagttgcatccaaaagaataaaatactcagaaatagatttagtctgggcggggtggcttatgcctataatcctagcactttgggaggccaaggtgggaggattgcttgaggtcaggagttcaygactaacctggccaacatagcaataccccatcactattaaaagaaatttgaagtagtatgagacttatataccaaaaactacaaaacattgttgaaagatattaaagatctatataaatggaaagacatcctgagtgcatggatcagatttactattgttatgattccaccactacccacattgatctacagattgaacccaatctttatcaaaattgtagctggcttgtttttttgttttttttttttgagaaatttacaagctgatcctaaaattcatatgggagtgcaagggacccagaatagccgaaacaatcttaaaatggaaaaacaaagttccaagacacacttcccaatttcaaaacttaatatgaagctacagtagtcaagacagtgtgatattggcataatgacagacatgcagatcaatggaaccgaattaaaggcccagaagtaaagtctcacatagccaaytgattttttgacaagagcgccaagaacctttaatgggagaaagaatagtctcttcaaaaaatgatgctgtgtcaattggacatccacatacaaaataatgaaattttatccctaccacatatcatatccaaaagttaactcaaaatgggtcaaagacccaaatgtaagagctgaaactacaaaaatcttggaagaaatataggcgtacatctctgtgaccttgggctaggtgtcttaaatatgatatcaaaagcatatcaacaaacaacaaaaaaagataaattggacctcatcagaatgaaaagtttttgtgcttcaaagtgaaaagacaacatacagaattggagaaaatattttcaaattgtatatctgataagggacttgtgtctacaayatatgaagaattcaataaaaaagcaaatactccaattaaaaatagacaagatttgaaagaaagaaatttctccaaagaagataaacaaatagcaaataagcacatgaaaaagaggttcaacatcattagtcattagagaaatgcaagtcaaaaccacagtgaaatactatttcctacatactagagtggctaatatctaaaagacaagtgttggtaagaatgtggagcaattgtaaccttcatacattgctggtgggatctagaatgatacaatacagccaccttggaaaacagtttaaacagaattatcatttgacccagcagtcttactccttggtatatccccaagagatatgaaaatgtaagttcatataaaaatgtgtacatgattgttcatagcaacattattaataatagtcaaaaatggaaacaatctatatgtccatcagctgatgaataaacacaatgtatatccacacagtggaatactatttggcaataaaaagaaatgaaacactggcattaaaaattcagagattagacagggtaggaccactagaaatataaactgcattggttattttcaactctttttaatccaacagttttaaaagcagcctaggcaagattaccagaacctctgccttttattttctgttcttctctctcgctcttgcccttgtctgactcagagtcagtgggcgaggagagtactattaaaggtaaagggcttatatggtacttgaaacactcactttcctgactaccaaatgtatagaattgagaagacttgggcrttatttattctaaagatacagagaaactaaggtcatagtttcaatttgatttaaaaaggggtttaagcaattgtgtattagtaatttattactgagtaacaaattacctcaaaacttagtggcttaaaacaataaacatttgtcatctcacagtgtttgtgattaggactagagagcatcttatctgggtggttctggctcagggcctctcctgaggctcctgctatctgaaggcctgactgcggtggaggagctgcctcccaggaggctcacctacgtgcttggcaagttagtgctgtttgttgcccagaagcctcagctctttgctacatggacctttctccatgtgactgctttagtgtcttcaccttagagcacgtgatccaagagagaacaaggaggaggccacagtatcttttatgacttagtcttgtaagtcacacaccattcctcttgccagaatctgtttggtagaagctagtcacttagtagtgcccacatgatctactaaggagaaataagctccacctagtgaaggaaggggttaaagaacttgtggatatatttttaaaccactgaacaatgactgcttaagtttctaacctgatatacatttcaaataaattttgcagtgtttaactgttcttcagagactagatgtttggctttctggtgggaatgacctgtgtgtrtggaaccgaaaattagatctcctgtgtaagactagccacctttctgatacaggtaaaaaacatcaaggtaattttgaactatgattgasagactagaagacacagcagatcttcagagagactttccataagtagaaaggtcaatataggggatttttctttttcagttctgaagatarcaggtagccatattcaattcagatcggggttgtgtaaaatatatttttatcctgaatcaggaggagaagactccactcargaacaaccttttccaatgctcttgggctgttttcctgaactgtgtttgrtgagcacgctgatacctagaagcagacccttacgactttacagtagcatttgtggggtcattaactttgaataaatgcctaaggatgacctctttttacaattgtccttaccaaaaagatcatacatgtgcaagcttactgataaagttycattttctcacaattctgtgtacatacgattttggtttcaacagaaaaaaaataatcaaatcagttttgactttttgataccaaggatcttaaaaaataaaatctatttttagagtaaaatatttaaatgagtagattttaataacaaccttgaagtcacactaactattgttatttctaaaaataatcaaatgagcctgggtatcctagaaggaacattgttgtgcatgttgttgatatttcagtggtagcaggagccctgtgaattgaatttagttactaataggagctagcttagctccacgtagayattttaaagtatcagaaacataatgacttaggaaaactaaatccatacattgctagggtttacaatttaaccactcagttcaacatttgattactaatagtcttgctcaaatctagaatatatttccctgtttactattatcatgaattatgtgtctttatgttcatttttctctctctttcactagcctgtggttttcatgaattttattttggtaaagttatattgtaaaatgttgaaattggggctgaaaagaatcttctgtgtgttcctggaaatagccacctcttattgcagtctccctttgttttgcaagttatgtttaagtactatatattaaatcattacaatactgccatttatcagtgtctcaagagttaacagaaggctttgagggtatctrtgggaaagccttgagaaggccatgggttactattggtgagctgttcatcatttgggttttccaaattactggaggccagattgttaatagtgttattagatccttatgtcatgatgtcctttcataagccctgcttgatttatggactgstggagcttttacaagcagttattctgtgtttggaaataagcaaagacaatcttagtcaatgtgatacaatggaaggagccctggactaaaacacagggcatccgtgtcctttccagtaatatgttttgtgattctgagtattaggttgctacatctggattgttgggcttctagtattttcacatataatttagtgaaagatttttaaacaagctgttttctgcatttagaattcttctcttgctayccaccctgctgttctcccatgtcctctgccttctctgtaccattcctttgccttccttgcagcaccatttcctccttcttgtacatgggaaaatacaaaacctactgttaaaatatgcctatgtggagaaaaatcttggccagaaatactatccaaatcacaacagtcagtcctttgatggatgggaaggataagcaaatgactagaccgttttctacacttgcatatatattataaattacatatatatcataatggaaaaattraacaggtttttttttttttgccaacacgtggtggttctaatwtatcaactcttttattcatactgacagaagcaaaattgtaacatgccttgtagaagttatagttacgctaaaatcattaacctctttacttaaataagtgaagtgtgttagaatgttgaatctgattctttcattaatagaagaaaaattttacatgtattagtggatcacaaacatgctatttgaaggctgctttcttagctgctgactgttggctagttcattcaatgccagggagcctgctcaggcttctaaagtttacatgaaggaaaaccccaattttacatcacttttgagctagccatcttgtaaatgggtgatggtgattatcttaagggatccctggtaaataagtgtgaattgctgaatctaccactttatcacaatagtraaaaaaagtacaaaaaaacccaaccccatattctgctcttaataaatcaataatgtcttccaaaagtctcagaaacctacatttaacaatcattttccattagtaagcaagcaaggaagtgtgtgtggagctagttctgtgtgctttatcttctttatggaaaacgactgacataaaactgagaatgtttttgtttttgatataatctgtgagaaaaataatttgaactttgttttatatgtttttggaggtattagtgctttggttgaaatacctaagaactgtgttgtggcagcagttggcaaagaactgagtgagtatgaatttttttctttttgtgtrttttgaacgagaattgtatacacatgctggaaggactaaagtaattttttatttaagggacattgcgtgtgccccactcttggcttcttgggattgttgaagtgatacagagactaagacattttcaggatgttaggccaggtttctttttcttatcagtgttttaatcagtatgttagcttggttaaacagtttattgcttgttattccaaaattccagtctcaagatcacttcataatattccaactaaagtagaayttcccataagttcaatgtgtatcagaaagagttctcttttctattgactgaaaaaccttcttttgacaaccacagtttgaatatgagtagctgtcaggattaaataacctggwtagagatttgtagtttggtaaaatattgtcagagacacagaaagaagcatggcatgacctatcttctagagagaaatgtgagaaagaaaagatamtttcgtaatttgaaaaggacatgatctcagagacttgtcacttctcagatgttagtgatrctaatctttgagcatccacagcacctggtccagtggygtatttttaaaacactcagtacattgayggtaagcctgtttataaacaagtctctctcccactctagactgagcatttgtgactgggccttattcacatttggtacgtagagttcctggaacataaatgtttagtaaatgatgatagaatcacgtctgtggattttattatgggttttctgtattgattaaagttaggatttatactagtttaaataaaactgtatttgttaaagtcagataatgagtaaagcaacacattgaacattactatagtcagaagaactgtatgatatataaacattataagacatactcagagaatttataatttaatggtatatgcctaggaatcagaagctttttaaaaaagaagttgcttatgtcttcactgagttgaagttaaacttggatttgcagcttattctgtmgcaatgcttacatgagtaagagacatgagtagagaaagctgatgttggaggtgattgagggatgtgggctagtcactgattagggagggagtgagttgagataacaagacatccgttgaaaccctagagagaatgggagcttcactgtttggaaaagtcagtaaaggaagagagttcttcaggacacattcagtatgggttttagtagatcatctcaaacatctcaagcatttgaaagaaatagtttaaagtagtatgaataaggcttttttttggagatggstttttcagtatggtaggtatttttcacttaatgaaatgcttgtttttagagcaggagtagtattttatcctcttagagcattgtaataaaattttatctgtctttttcatttagtaattttcaggttggtagcacccacagaaggatcactagaatgggatattcttgaagttaagcgcctccttgatcaccaggataatattctctcattgattaatgtcaatggtaagctcattgtgtacatttattatgtacagttttgtgcttgttaacacaacctgctctgaacacgagccttgcttagttctgggattctagaataagtcactaaaataatgggattgtcattctcttttactctgaagttttagccggtggagctgagcaagtttcctagattgctaggtctaagatttagggacaaggaaaatagtgtaaggcagagaaaatagaggagaacataatgatctcaggcactgcttggtagctgtgggatgactgtcacaggctgtttcagcatttttggcagctgtttctggctagttcctcttttgtagagagattggaaatatgcccttttgtcttgctgtccacaccatacaatatcacatagcaagttacacacttacactagaatgagcaggattcaagccagttgtaatcctggttgaagactctcaaagaataataccaaactaaagtaaaagtctgcagaaaatgggtcatgtcttcccttccttcctcgtggtgggggttttgacctgctgtacatcctatttggcttcctaaatgattttaatgagtatctcctgtgagctaaatctgacatcagatggcaagatcacaaaccactgatcttgacattcagttcacttgcagataagtgacagcttatatcatcagaactgtgctgggtgatctgtgtatgaagtcacatgagagggcttttggtggcttcagtttgatagtctggtggagcctgcaggacgatcctgtaaggctgcttgggagtatgatgtagtgggagggctagacagcaccccagcaacatatctccctgaggcctggcttggctttgttttttttgtttgtgtttgtttgtttgtttgtttgttttgagatggagtctccctgtgttgcccaggctggagttcagtggcatggtctcgactcactgcaacctctgccccccgggttcaagcgattcttctgcctcagcctcccaaatagctggaactacaggcgcatatcaccatgcccagctaatttttgtatttttagtagagacggggtttctccrtattggccaggctggtctcgaactcctgacctcatgatccacctgcctcagcctcccacagtgctgagattacaggcatgagccaccaagcccggccggctttgtttttaagcagtattttgcgtgaatgtgagacaaaggggagcgagggacacagagagtaccaagtctagtctccatttgtgtccattcagtcacatgttcagatacaccagtaagagtgtccctcccagctccaaaatcttcctcccaaatagccatcttattgtaaaactcagctgcaggtctttctaaggactagattgtctgtgttgatagaaataacaatggttgctggtgtccctttaattttctctgggggctctttttctctagccatggatggagacagcacagaaggcaagttcttatttgggaagccctctgaagcctcattggtgacactgagtcttaagtctcaagttcccagggctgctgagaaaagcccagcagtattcggcccatyacaccggtcatgcttagttattttgttttagcagtgaagcactggcaccactgagccagcatggttacttaaatgaagatgataggatgatacaagatagcctgaacttcatggcatgtcttttaccatgtgatatgcagaggaacttacagcagtttctgaaagctttcttcgagtattcatttgccaaattcgtaaggggaaaaaagggaaaactaaagaaaaaagttgtttatgaaagttacagaaagcctcatgcactttttactgttttttactatctttttaaaaaatttcttctaaaaaaatgggatacatgtgcagaatgtgcaggtttgttacataggtatacgtgtgccatgatggtttgctgcacctatcaacctgtcctctcagtttcctccccttccccacaacaggtgctggtgtgtgttgttcccctctctgtgtccatatgttctcattgttcrgtttccagttagagtgagaatatgcggcatttgattttctgttcctgtgttagwttgctgagaatgatggcttccagcttcatgactatgtccctgcaaaggacatgatctcattcctttttatggctgcatagtattccatggtgtatatgtgccacattttctttatccaatctatcrttgatgggcatttggattggttccatatctttgttcttgtaaatagtgatgtagtaaacatacatgtgcatgtgtctttgtagtagaatgattgatatcctttgggtgtattcccaaagtaatgggattgctgggtcaaatggtatttctggttctagatccttgaggaatcgccatactgtcttccacaatggttgaactaatttacactcccaccaacagtgtaaaaatgttcttcccattctccacagccttgtcagcatctatggtttcctgactttttaataattgccattctgactggtgtgagatggtatctcattgtgattctgatttgcatttctctaatgatcagtgatgttgagctttttttcrtatgttttttggccacataaatgtcttgagaagtgcctgttcatattttgcccactttttgatggggttgtttttttcttgtaaatttaagttccttgtaaattctggatattagaccgacctttgtcagatgggtagattgcaaaaattttctcccattttgtaggttgccttttcactctgatggtagtttcttttgctgtgcagaagctcttyagtttcattagwtcccatttgtcagctttggcttttgttgcagttgcttttggcatctttgtcatgaagtctttgcccatgcctgtgttctgaatggtattgcctaggttttcttctagggtttttatggttttaggtcttattaagtctttaattcatcttgagttaatttttgtataaggtgtaaggaaggggtccagtgtctgttttctgcatatggctagccagttttcttagcaccatttactgaataggagatcctttccccattgcttgtttttgtcaggtttgttgaagatcagatggctgtagatgtgtggtgttatttctgaggtgtctattctgctccattggtctatatgtctgttttggtaccaattccatgttgttttggttactgtagccttgtaatatagtttgcagtcaggtaatgtgatgtctccagctttgttctttttgcttaggattgtcttggctatacggggtcttctttgattctatatgaaatttaaaatagttttttttctaattctttgaaggatgtcaatagtagtttgatgggaatagcattgaatctgtaaattactttaggcaatatggccattttcatgatattgattcttcctatctatgaggatgaaatgtttttccatttatatgtgtcctcccatttccttgagcagtggtttgtagttctctttgaagaggtccttcacatcccttgttagctgtattcctaggtactttattctctttgtagcgattgtgaatgggagttcattcatgattttgctctctgcttgtctattgttggtgtaaaggaattcttgtgatttttgtacattgactttgtatcctgagactttattgaagttgcttatcagtttaaggagttttttgggctgagatgatggggttttctaaatatacaatcatgtcatctgcaaacagagacaatttgacttcctctcttcctatttgaataccctttatttctttctctttcctgattgccctggacagaacttccaacactatgttgaataggagtggtgagagagggcatccttgttctgtaccaggtttcaaagggaatgcttccagcttttgcccattcatatgatattggctgtgggtttcttataaatagctcttattattttgagatatgttctatcaatacctagtttattgagaatttttaatatgaaaggatgttaaattttatcraaggccttttctgcatctattaagataatcatgtggtttttgtcattggttctgtttgtgtgatggattacgtttattgatttgcatatgttgaatcagccttgcatcccagggatgaagcccacttgatcatggtggataagctttttgatgtgctgctggatttggtttgccagtattttattgaggattttcgcatcgatgttcataagggatattggcctgaagttttcttttttttgttgtgtctcttcctggttttggtgtcaggatgatgctggcttcataaaatgaattaggaagtccctctttcagttgttcggaatagtttcacaaggaatggtaccagctcctctttgtacctctggtagaattcagctgtgaatccatctggtcctgggctttttttggttggtaggctattaattactgcctcaatttcagaacttgttattggtctattcagggattcgacttcttactggtttagtcttgggagggtgtatgtgtccaggaatttattcatttcttctagattttctagtttgtgtagaggtgtttatagtattatctgatggtagtttgtatttctgtgggatcagtggtgctgtcccctttatcatcttttattgtgtctatttgattcttctctsttttcgtctttataagtctagctagtggtctattttaattttttcaaaaaaccagcttctggattcattgatttttttggagagtttttcttgtctctgtctccttcaattcttctctgatcttagttatttcttgtcttcttctagcttttggattagtactttttactttataaactctatgactataaaattatactacagataataaataagccaaaggcgtatttaggaatcaaacatgaccaagtagtctgttaaaatttgaaaatgatytgctgacagtctcatcttgcagtacataggcacgttagccatgatgtggatgtcagtgatcctgaaatgtttatgttgtacagttccctgcttcacttgcaggagctctgctcctttctcctcacccattaccaatgaaagatatggccagttgcttgggattgtacatcacagggcaaatctgtttkcagaggggtggccccagggcaaccttagaattgtatgagagaataccaacaagtgtggataatgaataccagatttgctaaaaagattggaatgcccaggcagaaggttttctaagacagacaaaaaataactgataatctctccaggcagaaggctctgggtgctcctttattttattccttttcttgtattatgttgccagcatcttttggtaatcatgaagtactagtacttgtgagggatggatagacagataccaggtgagattttcatactaagtggcttttgacacaggatgaaaatccatccactaataatatataattgaggttgtttgtcatgaaacattttgaatgacctgtttgggaattagtttgccatgtgtaaactgcttaaaaatatgtgctgattggccaggtgcagtgactcacgcctgtaatcccagcactttgggagcttgaggtgggtggatcacctgaggtcaggagtttgagaccagcctggccaacatggcgaaacccgtcactactaaaaatacaaaaattagccaggtgtggtgtcacatgcctgtagtcccagctacacaggaggctgagacaggaattgcttgaacttgggaggtggaggttacagggagccaagattgtgttactgtactccagcctgggtgacagagtgagacttcatttcaaaaaaaaaaaaaaaaaaaaaagtgctgattgagctgaatgccgtattttatttttagggaaaattccaactggtcattaatattttgtttctactgcatggaggtatcacagacacttggaggattaagtcagagcaagcagctgcatggtctcagtaggttaattctgtgttgtgactacagatgcagagtgagagtcaaggggaatcttcactccttagcttctctggttcttttgtagtttgaatgaaataggaaaaaggagggaaaggtgtgggaaagaaggtcctgggaagatgagtactgccttaactttcccactactaaaactagaagcccgttttgctccacagatgagaagtgatttctccacagagcaagttctatagagtctgttaataaactatagaaattagatattaataatctacctattatggccttggagtcaagacaaataatatttacatgtaggattgctggtaattctgtatctcttaagagattgttcatgtggtcattagagatttctgtcgtgctggtttatttgataaatgaaataattaaatcataattactcatctgtatattcctaaattaacaagtaacaggatgttttaatacgattaatgtggaataataccaggggctcaaaatactaccaggggcgcaaagataatatttgatgtctttttaaaatggctacacgtttattattcaatttgatttttagtcactcatttaatgcatgargaatccaagataaaggttaaactacttcctaaagaccacctgkctagcaacaggcagagccaaaatcagaacttgggtttctagactaagtgcattatastcttctgtcttaccctaaatatgtaataatttaaataaattacatttatttgaaataagactagcagttgtacattttctattaaatatatagtgtgtaaaataaataatatgtaaaatggaaaaaaatcctttttttttttttttttttttttttttttttggggagacagagtctcgctctgtcgcccaggctggagggcagtggcgcgatctcggcttactgcaagctccgcctcccgggttcacgtcattctcctgcctcagcctcccgagtagctgggactacaggcgcccaccaccacgcccacctaattttttgtatttttagtggagacagggtttcaccgttttagccaggatggtctcgatctccagacctcgtgatccacctgcctcggcctcccaaagtgctgggattacaggtgtgagccaccgcacccggctttttttaaaggttttaaaaacttgtaaaagttatacatagtcatagtagaaaaatatgaaaatagtgaaaaacattaaaaatataaaagttaatattaaaatctttccactatccagtattaaacaccagtccacatctttctaggtgattttctgggcctatgtrtgtgtgtacatgtgtattaatayggtttactgttttgtaacaatatgtcataaatatatttccatatctaagtttatattgttaagcatacttttataacttaatttttaataacagcattactatttcattttgttgatgtcttattcaattctcaattcgatgtgtagttatcttcagatttttaagattgtgtatttgtacatatatgtatgtaacaaccttgtacatttatgtatttccttcaggataaattcctagaagtggaattgmtggatcgagatttacatttttcaaggttttgatacatattrgcaaattaatctttgaaaaaaatacyaatgtatagtagggcattaggcaatacaggaatgtgctgatttcttatgcttttgccagtactgtgttgggtattttcctgttttatatttcctgattcacaagtcaataaatggtatctccttgtttttagatttctttgattattaaaggagttgaacatcttttcacgtttactgaccatttgtatttgttttgccttttcaggtccttttcccatttttttttctgctgtatttatcttgttcttaataatttccaagaactccttatgtatcaagtataataaacctgttttgtcatccaagttgcaaatttttcccagctttttgtcatttcagtgtatttgtgtgtgtgtgtgtgtgttttagactgagtctcgctctattgcccaggctggagtgcagtggcgcgatctcagctcactgcgacctctgcgtcccaggttcaagcagttctcctgtctcaacctcccaagtagctgggactaaggtgcacaccaccatgcccggctaatttttgtatttttagtagagatggggtttcaccatattggtcaggctggtctcgaactcctgacctcaggtgatccacctgcctcggcttcccaaagtgctgggattacctcgcccggtccttgtttttgttttgccaagcagctacttactaggatctcttcccctggcaccccactctgcttccgttagagccctttaccactccacattcctaaaagtatkcacctttatcttcttccatcctttaactaactttcatgttttaatctatttgaaacttattttggtgtatggtacaagataaggttcttttacttttattccccttaaatgtaaccagatattccagcatgagatttctttactgaaatgaaatgcaatcattattacatactaaattactaagataatttgagtctatttctggccttcttattctgttacattaatctttctgttggcttgcctaggtacctcactgttctaattactgtggttttatasggcattactactagacattccawtcagttatatctttacatagataaaatgatcgataatgaggcatatgtgaactttgcctagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagaggtaaaaaatgtatacaytatctataaacttgcctttgacatatataacccaatttctgattttaaaaatttaatcccatgttggacataaaaaaggtatcattcatggtttcaggttgtgctttaaaatggtctttttctaaaattggatgatttgtgttaagcattttaatctttgcttctaatctcgaggcaaggaaatgattaaatggccacagatttaaaaattattgaaattttgggttggattaaataatcccattggatttgaggttaatgcttaaaattgttttaagaaacactgtgaaaaagagttcttttgaagatctgacacatttcctagtgaggcaaagaaaattaaaaattttaggagtgtttctcagtctgctggcatctkggggcaagataaattgagtgagaattgttggattccatcttataggacttgggagtgatgctcttgaagcactttagatctgttttgctgtgagagattagtaccaatggactactgaatcttatctctgatctgaaaaaacaaatctcttagcatcaggggctcagaaaatgtttttaaagggcaattaacttttctaaatgtaatcacaagaaatgtttatgayttgtacccttcgaggagaaggagttggggaggcttttctctattttgtgactttctatactgtttaatttttctaacggcatgcacgttatttttattaaaaatttcagtagtagtgttatgtagtggggggagaatatgatccatttttctttgtaccactctttaaaaacaaaacaaaagattaggataggaacaggacttagaaacactaatayattcaaagattgtttctttgtatcccaactttattttgaaaaaagttaaatatacatgataaagacagtatggtttcagaaaagatagagactagatcactaagagttgtagccctacaaattatctattttaaatgttacatgttttttctcacttttgtgaaaattaatatttaaaagttttgtattttaatcttaaattttttaattgatgtttattttctactatatatgcttgataaagcattgtatagttttccctaatttttcttcttttgttgtgagttctttccttctataagggaccgttagttattgatagcggggatagcatccccattgagtaaatgctgcctccaaagctcatgaattctctagttgtgtttataattttcttcctgaccttggataaattacttaaactgtgcccagatttcctggtctatagaatgagtttcgggggattttggcattgaatacaatccacagggctttccattttagtacattggctagcagtgttcattaatgccctggcattgggcctcggctgcattgctgattgcagagtactaatcctgagagtcaaggggatcattcmagatttaagattccagcaagccttgggggcatgctttggttcagttactataggtctgagttgagtttgtagtcttggaggctgtgtgagaaaggttggagagcccagaatctctggtgaaaacaagaaggcaatatgtagggatatttgaaaggtctgcctcatggggatatctattgagtaagaatggatgattctaggacaggtgcttgcaaaaatttcaaaggctactactgcatgtgagtcacgtgaggaatgagcaagggactggagtaacatgaccttgattstaatattgactccatgtttcatttcttgtgtgactttaatctctttaattttaaattccttatctggaaaatggcaatgatgcttgcctttcttaacacgatgttgtgaggctgaagtgagataagtattagtgaaaatgctttcaaaagattaaagttgttttagtaaaaaggtatttatttctaatagtacatttggaaaaatgttttttgaaaccttcagaggattgcatgatgataatgccactgtagccgtgcttttttgtatcacttgtaggtctcctgattgcttaagatgtggaatgcaagtaattttgcttgcatttttcaggcagaagaagctaggtaattttcccaaggatayagtgttatttaaatgaaaactcaggttatccctcaacagcttccactgcagggccaggctgctagctatagcttttctctagatatatttcagtgaggaagaagtggcgctaagggatatactatgcagacctacctttctctgcattagtggttgtgtcctaccttctaaatgctcagagctttctttagtgctttgacattttggggtttcagagattagtactgtaatttgggctaaaggctaggaatgggaaaggtaatggtgkctttctgatgtcacaygagggctggaaatccattacactaggaagggtgagtgytagttttatgcccatttctgaacttcttcccctagaatgtatttgctgcagttggaaggggtttatacgtgtatagccttcaaatgaagcgtgtgattgcctgccagaaaactgcacatgactccaatgtcctgcacrttgccagacttccaaacaggtacaagttcccatctgttctgcaatagatgaaagcaagtcacagttcccagggctaccagtgtaatttctcaagtggccaagttacctggcttcatggcttgacctgctgtgttcttttggaaatggagaatgcctgagggctgtctctaacagaagggtatgtggcagtatattacagaatttacaagaagcaaggtgcaaatgaattacattgaatttcattgttaagaagagatgatttaaaatttggtatttaacaacataaacgactttggggccacttacattgtaccaatttttatatttctcataaacctaccttctttttgtttatggccagaatcaaatggttgctggtctccttgttgtgtgaggctactaagtgagtggtttcctgtcagggtagatttgctgctgagcttctagggacgaacatatggacagggactatcattattttctatgcaggatatttttatagtgaagcacccagagaagagaggkagcaagaggagggaagggggctgcttaggacattgtgaagtataattcacactgttttcccaagggcatttttttaaatggagagaatcaatttatagcatttgagctaatgtaacgagtaacatgtggctttcctaaagggtgcttttagtttgcgttgtaacgtcatgctaaattgtratttttgtcagttcctgctaagagctgaataaaagcagttgagggctccactgatttctttcactgcaaatttagcattggccctcagtggtgcgctctttttgtattactgattttctgttctgacaggcagttaatctcatgctcagaagatggcagtgtacrcatttgggagttaagagaaaaacagcagcttgcagctgagcctgtaccaacaggtgtgtgtcttctctcaaaaaggtagtctttttctctccttttttctcacgtgaaaggcaggagaaggacaattatgtgaaaccactaaaataatatagaaatgctccaaataggcatcagatgtttatagaaagcatatggtaattgagatctaggatttacagcttaatactgccctaatgtagaactgccacttcatttcaagtaagatagagattttcttgttttgagggaaaacttactttctggtaatctgaatgaccaratggcctaatgaagtattcatttatattgtctataattctgactgatacacaaaatttgtaccgtcagatgtcaaaccaaagtgttctttacccttgatgttgaacttaatttatgggaaaacatacttttccttgtgtgcttatatcataattttatgagctcttgacttccaggtgtttagtttgaaaaacaaaactctgaagggttgaataaattagttaccaacctttgcacaagaaatcagatgctggtacctagttgtttctggtccttttgacttcctgaagtcctggggtgttgcttttgcacatacatatacagcttttcccctatgccttgtttgttgatctgagttttgcccttttttcccttgacagttagacactgccattcaagctttgtttctgtcctgttttattccaagtgtctttttgttaatatacctgcaccagtgggtgactaggggcaataaaaagagatgaagaacagacctggttagctaagaaagatgaaataacatattcacaaaaccctagcacggtgctcaggtactgtccacttagcccttgactaaaataagtctggaacctcttcacatttaaattttgtttttctgatctcatgttattgtaagtacagagcacartaaktttggaaatgattctttttctaggtttttttaacatgtggggatttggaagagtcagcaaacaagccagccaacctgttaaaaagcagcaagaaaatgctacttcatgttcactggagcttattggagatttgattggacactcatcatctgtggaggtattgctgtttagccacagaatgtccaagcaactcctgcttttgcatttcattgctcttttctttcagttgatctcataaaggcatatactttttcttatatctgtaggtgtttgtcagatctgaacatggaatgggataggctatagtatgtgcagttagggtctccctttccggatatatgatttgaggaaacaaggaatgcattgcttttaagaatggtcttaatcaccattatttaggagctggagatagctgacagtaagggcagtgtgaataatgttgactatatgacaacagtmaacagaggatgcatgaagggttgtggttatatgtgtatacagttaaagccttaacagaatcgaattccaggggcctttatcaaattcatgaacagagtcctgtttytcctgcctttgaaggataatagtttgttagctttaatgaaacctatgccttgattttcattgtgcaaatatgaaagttttagttgaaaattatgaaatgcgtaagcttttaacatgtagaaatccagatacattaatatttgctgcaggcatcattgcctgtagtgaaggaataagatcagtkgaggtaacagattagctgtgagaactaataacagtgtaatcagggccctaaggaatttcttaaattgttcttccctgtttcatagccaaagaacaaaaaatttcttttcatttgaaagggcattcatgcttaggaggagcagcggcagcatccttgttagtgagcatttcctgtatttcaggcactgtgctaaacactggctgctggagtttacagagagagatgaawacagtccttgccctcatggatcttacccttgagtggagagaaggggtatagacctaataggctgttaccctaggctgcatttgatggacccaagtaagcagcagtgactcagaagaaacatttcttgctgaatcttgtaaatggttagaggatataggacttgacacttgagctgaaccttgaagtttagtaggatgagtatatagccttgtcatcataagctccttgatgttggggtacagtgtcatagttatctttgctttcctctaacaagtagctcagtttttaactttgtgtttatggttgggaggtgagcatggactgtggtagrcagaagggcaaagatagcatttacgtggtggcaaggagcaccttgsctaggcyggagcgctgggttcctgtgaacagacactagtaggggataaagcctgggaacgtggtttggggtcagattatggatgtccttgaatgtaaggctgaggagtttggactttattttttaaatagtaggaactcattaaaaaggtttttagatggtagggaaaaccccatgtaaaagacattcaaaatgtgtttgaatgtggcacatttctcattctataaaacagtgtcagcttcttaggaattttcctgagtgaaagtgttgagacctgaacacttttaaaaagcatctccagcttcgttgataaaatctaggctrtctttgcagtgtcacctgaatttcctcatttctttttttttctttgagacagcatctcactctgttgcccaggctggagtgcagtcttgggtcactgtactctccgcctcccaggtttaagcaattctcctgcctcagtctcccaagtagctgggattacaggtgcccgccaccacgcccagctaatttttgtacttttagtagagatggggtgtcaccaygttggccaggctggtcctcatttctattttcatccttgctctactggcgcaacccctctacctgtgtactgaattttgtgttttccagtttcygaaggaattctgctcccatgtttcctcccttcactcctgcatcctcagctgagtcttatcctgtggtcttcagaaatgtatatgtcatttcagagaaaactcttgttttttttcccgagagggagttttgctcttgttgcccaggytggagtacaatggcgcaatctccactcactgcaacctctacctcctgggttcaagcgattctctttcctcggcctcccgagtagctgggattacagatacccagctaatttttagtatagacagggtttcaccatgtttggccaggctggccttaaactcctgacctcaggcagtccacccacctcagcctcccgaagtgctgagattacaggtgtgagccaccacgcccggccctgtttctcttttatttcaccctttccttcgaggacctcatccttttcattgattcacttttctgatacaactcttcaccccatagtattcatgctgccttttgtcaacactctgttttcctattcttagcttccagcctattccttcactgggcaagccccttccccttacttggggcattttctccctttgaagctttttctgaatttctgtgacatgtcrtagtctatactgcattatttagtacctgattacataatctctcattggtacctttattgtttcaattatgatttgcttttcagaatcttcttgagggtagggaccataaacstagtgctgacacttaayacctatggattgagtatatctacttttatagagagctgaagccagtgtttatcttgggaaatttagaattcagacattttttccatagccattatacagtataagtaatggytaagtaaaaccaatacttgaaaaatcagatkatgaaaaaatctggaagaactatgagaattcatgtactttacaaaaatagctattctgtagttgaacaatattaacaaaattctgattaaaatattagatattatttgtatgtgacttaccaatactgaaaaatgaaatgaagttctacacccagatccaaaggagtctttaaggcacatatctsasacgcacatgtgttaatgtggtattagacacttctctgcttttcggggtccctataatcagttttaattttctttacagatgtttctatactttgaagatcatggactagtgacgtgctccgctgatcatctcattattttgtggaaaaatggagagcgagaatytggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctrcatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattktaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatraaaatattagaaagtagtctacacattaaagattgaaattcttaamctactgatgaagaaagggcaacgtgacwgatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacaygtaatactatttaatagcattttacccacagtagaacttctttcaaaatttagagtctgtcatctcaaatcctgatgctcctttatgaactaagtttatagaatattctaaatcctttgttgtcatttcaactatgttkacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaacagatatgctgtcatctaggctttgttattccacttctagagcataggcagagtagatttaacataattcttaagggccttaagatttttggactggtaaataaactctgacttcaacttaaaggcaccaactacactcgctggcaytgaacttcttctccccagctatgaagtcctagatgacatctcttctaatagaagaccatttcatcttcacaaactcagttgtttagtgtagtcgccttcagtgatcttagctagatcatctggacaacttcctgctgttgttgtcccttgcactctgacgttaatggggatagtttcatgaaccaacctctgcttgcttccagcttttcttctgtagcatcctcaccyctcagtcttcraagaaagaattgaagaattaattaggctttggcttaagggaatgttgtggcttgtttaatctatatagaccactcagactttctccatctcagcagtaaggctgtttcactttcttgtttgcatgttcactggagttaacactttcaagaactcttcctttgcataacttggctaactggtgtaagaggcatggctttcacctgcctgggctttcaacatgccttcttcactaagctttattatctgtagcttttgatttaaagtgagagacatgtgactcttttacttgcacatttacaggctactgtaggttattaattggcttaatttcgatattgttgtgtctcagggaatagggaggtctaagaagagggagagaytggaaaccgctagttggtggaacagttagaatatacacaagatttatcaattaagttcactgtcttatacgggcatggtttgcagtaccctaaaacaattacagtagtaacaaagatcactgatcacagaccaccatgacagatacaagaataaaaacatttgaaatactctactctagagttaccaaaatgtgacacttacacaaagtgagcccatgctgggaaaatgccccgatagacttgctctatgcagggtggccacaagccctcaatttgtagaaaaggcagtatctttgaagcacaatgaagcagaatgcaataaaatgaggtatacttgtattctaattttctgccatgaaaaactgtctagagggcagtctccaaccctagggactagattgcttttgttttcatgcatgccctaaggtcacagagatgggggataacagtatgatgggagattctggtagggactcaaacctgatggtgttcagtagttgcaggtagactgctgctaaaagttggactttcaatttagaataaaataatgggtcaatgtatattatgtacattttctccatttcctgagtttagctttcaacagttaagatacttgcaacagcagaagtaacactacatagtgttacagtgtacaaatcccttgtcatttttattttaaaatatatttattacctcagtctctggctatattcacatagcgcaagggcacaagatcatcccttctgtttctctctctaaagctgagtaggttctgagtgaactgacaggcttgttttttttttgcccagaatgctaaccagtcctgacatggagggcaagtaaatttaaaaatcttaaattagaaataaagaatgatcttaggaaattatagggtcattctggtccagcagtgttttataactggcttccttctcttactagtcacggaaattattagagagtgttgcattttcctaatacggcccycctcagcacatgacatttaagtaaacaactctgtgtaagaggcagttataatagtttatataatataaactatctgatacacatatcatctgaaagcctgtatttctaacaagttgactatgtggaagaatagactagttcgcaggccagaagattataccgtagattacactggtaaagagcagaaattgttgacgctttagtacctagctgtcttaaagcatttttaaacatttgcacattactaataaaaagtttgaagttaacaagaaatttgacataaaactgagtaagctgtaaatatttcatatagaagatgtctgacacctgataaatgttacttaccaaatagaactgaaagtgagatgatcagaaaaagattgtccttgcctcaagcaagcttctgaagcctaggcaagttagctaggtccttaatatgggattctggcatcctgattttaatgtgctctgaaaacaaagtgtgtgactcatgaaataaaggacactaaaccccaaatttgaaattatgaaaactttaggccaaagaggtaaaataaaaacagctgttgggagtgaaaaatggctgtaggaatttagttacaagtacttcacaaaaacattttcatcacwtttacataatatagcattacaatacaaagctggctgctgtcctgaccaagcaagttctcttatcatctaacaaaaataatttagatacatttctttgcatggaattgtcatatttttccatttttggtacaaaacatagaaaaaaacattggcacattatgtagtgataagtcattttttccccatgtacaagttccaagtattctgcattccaatttgtattggaaaaaagtaattactgattcaattaattcagtctctgtttgtttataccttttaaaaatgcagcatgaagtacagagaaagaaaaatgaagtttgtttacggagtctaatatttataatacataggaaggatcagctggtaaaagagaaaggaaaatctcgagtctgactttatgtagatcacagggagttgtgaaaagagcagtataaaaatatgcacttgtgctttagaagcttttagcatacaattaatagcttaaaatagtatttactgcctccccatatgcctattttctgatatatttacaccacacaattttaacattgttaaagctaatggcatgatttcaaatatagactggttaaaaatatctgaaccttgaaacttcccctatcccctcccaaaatattacgtatagatggtgcatggcacaacatactgcatgggcttacacccagaaaatttggattttaataaaaattttaaacatgtatataaactttttttttttttttaagaaaagcttgtccaagggcattcaaatttaatggcttttatataatacttggtgtagtgcctcgtggctgcctctgtgagccagaaataaaggaagctcatggattccccaaaaatgaaatgccactttttccctcatcatggatgactttgttaagatgaaccccttttacaggaaaggggttacacaggctgctgataccagtctagagagggcacccaccagccaaggctgtgttctaacttaggtgtcataccatcggccagaagaaccatgtagccatagaggctgtgaagctaactagtttatctgtaatttggtcctagttgyttcrcttattttatgtckttttttttttttcttagataaatctgttcagataagctccttatgaatccttcagatcgaygttcttgaggaaaacagtcaagctaaacagcaatgatgacttttatggtaaaggatgagctgatcactagctaagctacttagtcaccatcctgggagatgagctcacaggcaccaaggctttgcttcctgtggcctgctagttacagtgaaccagctccatggattgacaagggtacacaggatgacagcagagcaaaggagtttgccaagtatttgttctgtcattaagtattcaaaagaacatatatttttcttcatggaacataactttctaagaatgaaatttggggacttgaatgattcaaggtcaaatattaaacattagctccttcaccaatacctgtcattgtcattagaaaggaaggcctctyrtttacgctactgtgattcacagtgtcctttgtcggtcaagaggccccctctgtggcttggctttagctgtcagatggaagcctcaaacttttgcacttyaggtcatctagtgtcttccagtgtttgtagttgtcagccaaatgttgcatcagggctggcagatgtgcaaaggctgcaaagacagaaaagaatcaaaagaaacyggtgaacttagaccccaggagcatttataagcctgggggtgtctgggacaagtttgggatcagaattagaggaggcacaccctgggcgaagcatgaggacaagtcattaaacactagtttctgaaatgcaaacaggtcctttttgaaaagctgcttatcagtgacattatcagaagaacctgtgattcagagtaaactaaatacattttgcattctttctagagttttcctccaacgacagaaaaacactgcagtaagctttggcagcgtgtcctttgaagaggcagagactcgtttatcyagctatcaaaaatccatcaagtcttctgcacacaagcttctgtgccagctgctggggatgcaaagaatgcaccccaccccacttggccacaaaaagctgacagccacatttttaaaaatatattttgtttacctttaggctcaccctgtgtcactaaagataatattcgtaaagtataacaatyttctttgggtgacaaaacagtaactgtcttaccatcccaagcatcaaacatgtctgttatgaagtagtcaatgaaagagatctgagacttggggatgctacaggtattccggtcaaacactggcatcaccacaggtagtccctgtctcttctcttcatcagtctgtaagaaaaaaccaccacatagggctggaggacatgcgagacactttcacagtaatatcctgtttctcagaacaaccctgtgaaaatgggtcattatccagttttctcaatgaagaaataggctcagcaaggtcctcagacttacgtaagtcagctgagctacactgactacactcagaccttcccactctcaagcctctttttttgtttttgagacagtgtctcactctgttgcccaagctgtagtacagtggtgcagtctcggttcactgcaacctccgcctcccaggttcaagcaattcttctgcctcagcctcctgagtagctgggaatacaggcacctgtcaccacgtccagctaatttttagtagagaaggggtttcaccatattggccaagccagtcttgaactcctgacctcagatgatctgcctcccttggcctcccaaagtgctgggattataggcacgagccactgtgcctggccccaagcctctttctatgtgataccatagcatctcctgacacattgatctcagggtacttagccccttttctgggatctgcttttatcattgcaaagtcaaagctctgttcaatgtcatacaaacacgaattctcataccaaaactactgacatttacactgagaagaagcaatagtgggtaaaactgctaacaccttagcatgactcaatgaactagcaccaaactgtattaatagccatagtcattatattatttgctgccacatgtttgcacttaaaaaaagtttcaggccaagcccaatggctcatgcctgtaatcccagtgatatgggaggtcaaggcaggaggttcgcttggggcctggagttttgagtctgcattgagccaggactgccactgcactccagtttgggttacagagtgagatcttgtctcacattaaaaacaaaaaacaaaaaacaaaaaaacagaaccagtttcacttgagaattacctctttgaagcagtaagagttattaattgtattaaatcttgaccttcgaagtacatgtctctgtaatattctggatgatgaatgtgatgaaatgggagtacacgtacacttgaactgcataccaaaatctgctggttgtcttgtggaaagcacttatgcacttgaattgagctgaaccagctgtttttatccatggaccattattttcactggaaagaatgactgtcaaactatgattgttcaaacttgggtattagccttgcagcttttgaggtgtgtggaaatctgagtattctgcacattaaactaaggccatcatcattcattgagctgagtattaggatccgcatttcctggtggtgtattgagccagaaggccagctcaaaggcttcatttgtaactttcatttttaggtcaccctggcttatgaacattagtacattgctttttgggaaaaggacacctaaataggaagcttttatcaaaaaacttaaaagcacatttttctcatcctccattcacactgagaacaactaggagtagtacgtcaggtcctctctctgtgggtccggggaagcccattgatgagcagcttttggcttggcttgctcatttcaggtcagtcgatcaagcagccttaaaatatccactggtgttcaaggagtcatttgatcctcactcccttcctgttcttctctctggaaagctcagaactacctgtcctacttttcttcaattcagaggctctcttcccagaaagctgcagtctacttactggatttcatgaacagacacttctcaaaagacgacacacaagcagccaataaacataaaaaaaaaaatgtccaggctgggtgcggtggctcacgcctgtaatcctagcactttgggaggccaaggcaggcggattgcctgagctcaggaattcgagaccagcctgggcaacacagggaaaccccatctctactaaaatacaaaaaattagccgggcatggcagtgtgcacctgtagtcccagctacttgggaggctgaggcagaattgctcaagcctgggaggtgagggttgcagtgagctgaggtcatgccactgcactccagcctgggcaacagagcaagactgtctcaaaaaaaaaaaaaaaaaaaaaaaaaaactaaacaaaacaaaagtccagcatcactaatcagacatgcaaatcaaaaccacaatgagataccatctcaaactagtcagaatggctattaaaaagtcagaaaataacagatgttggcaaggttgtggagaaaagaatgcttatacactgttggtgagaaataaattagatcagctagcccctgtggaaagcagttcggagatttctcaaagaactaaaaatagaaattgctattcaacccagccgtcccattactgggtatatacccaaaggaaaataaatcattctactgaagagacacctgtacttgcatgtttatgacagcacaattcatggtagcaaagacatggaatcaacccaggtgcccatcattggtggactggatgaagaaaatgtggtgcatatacaccatggaatactatgcagccataaaaaagaatgaaatcatgtcatttgcagcaacatggctagagctggaggccattatcctaaagtgaagtaataatagaaacaaaaccagatactacatgttctttcttagaagtggtagctaaacattgggtacacacagtggcagaaactggaacagtagacactggagacttcaaaaggagggaagggggcaagggttgaaaaactacttattgggtactatgtttactacttgagccatggatcattagaagctcaaacctcagcatcagcaatatacccttttaacaaacctgcacatgtacccccaaatcttaaacatactgggctcctctgctggtcactccccttcccagtcttcctaggcatcatctattctttatcctgcccttatttatcctgcctccacagtacatttcagccatgcagaccccacaaaattcactacttgtggctgcttgtttgtcacccacacacccatcagtgcttagagtctcttctctggaagtagggctgttttcacatgtccatttacagtctactgctttctagatttctctcctttaactctctacactgctacaattaaagtgaactacatattgctcttccctttttataaaaattctatttcccctccctttgttaattttgctcagaatgctttgttcttccagaaagtcttttcctattccatttctgtagccccccttttatctagaaaaaagtctctctgaacgtctgtagcacttaacataaacttccttgagatacacttcattttttactaacatgtggacctatctacatctctcccctattggactggaactccccgtggccgcgatgtcttcactaatgcctgtgttcccataacgcgccatgtagacacccaggaataacctagtgaatgaatggaagatttctcggtttttgtgcaagttctggatccagcaaactgaagatgaaaagttacttccaaaggctcagtttatcccccttctcaagagactctggttagtgatcagccccatcagtcagctcctgaaggaaccagaagcctaccccaggtgggggtaagctgctttcttccagggaggagtggttaactaattggtaaaaagttactcagctggagaatcccccaggagttccatgacctagttcccattcccagaggggaagtggagcttccctggaaagatggcgcacctgtgcaaaatactcctcagagatcctcccagcccattcaatgcacaggtccaaggggcggcatgggttggccacgtcagcacacttaatcatcatgcgtttgatcaggatttggttttcagggaagttcttcccagcagggttgcattcacagtcgctgccttcaatctggaaaacagatggtcagatcaggcttggttcaagatgacggtgaagcccacaagggttaattcgccaggcattcgatggtgatcaccgagcacacaggtaggactgggactcggcgaaggcagcttttccttttttaaattccatatataatatactgacacattctttaaaaaaagaatatactgatacagtcttaaaagacactcagcaatacacacacacacagagtttgaaagttgaaagtccctgtcaccacctgtctacccctcacatccattttcttccctagaggtaactgctacagcagttttgtttttattttgagcaatttgatatgtaatcttagaggaaatttctcccagtttttttaaaaaaatgtgtaaaagcagagcttttagctactttaatgcatttcaggtagggcagtggcacatacatgtaacccttcaattatttcttgatttctactacttatgcctaccatctccctccctcctatgacctgtcccacccccaactcacccaactctctcgcactttggttctcctaaggcatgtgtccactcatgttttcttggctgttcttctgactggctggtaagtgagccaggtaggcgtggggtccttggagtaggaagtagtcaggagcaggtgtgttcagccatgtttagaaagactggtccacacctagtggtgatgtcagtgtcctgagccatgtggccaggacacgagttggtacacacatcacaggccatttacatagaacctgaaagattgttattctccacttttaaagacaccatcaaattgattgtgtaaaaacaattaggtctccagagctctgccaagccaaaaggctgcatgacatttggggggtttaagactggacctatttattagactatcaatgggcagaatatgttctggaggtttttgactacttatcaaagtaatactgtttactataaatactgcagttaatagtaagttgcagtgcagaggtgggggcttacatgagtggatgaccttcctagttctatgaatctctatacttttccttctctaaatccccagatccttgctcctgtaagtcttctgtggaaggagagggctctggtgttgtgctgtggaatccctgggggaaggggcttaaataggtgaggtagacactgtcactccatccagactggtcatgggatgggtcctacacagatcatctccttactgagcaagttactcatgatgatcattcacatccatccagtttgccaacctctgccgctcaacaggaatgagcggaaagcttttctacctttatggggttatgaacagcttcatggcttcagagaacagtggatcttattaggtgtgaaccttctgtttcatgttcctaaaagccaaattggtaaggaccttaaggcaggtccaaggtacatgagtaggttttaaaaaaggaaaacacaataaatgcttctgctttccagtcactcccagttttatgatagtcttcaggtactggtatgcttttaatgtgaatcaggaacattctttgttttttaaaacaccttccaactttgaggttttccaagagctcagtgaacagagaagtaaaggctttggattctctaaaataccaccatttatgccagtctctgttcgtctgcgtctccttccatattctttgggccaagcttttctggtcagtactggctttttctcagggcctttctttcaaggagctcagagttgctgtggacacagtttattttcatccccaaggaaaacaagtggccagtcctttcagccctttatcaactccaagtaaataaccaccttacatttgagtg

SEQ ID NO: 12392 - DNA, 22685 bp, Homo sapiens
aaacaggtccttcaagacagataggtgagaagtcgtatcctacacacagacacgcacacacacacacacacacacacacacacacacacacacacacactattggcctggcctctcaggcacttttctctctgcctagaacacctcttctctccacccagctctatttgcacggctgaaaacatccttttccctttgtttagaaaagaatgagccgggatttttccaaatgaccaattactaagaaaattgaagaaaaataaaatctcaaaaaataacataaagtagagatttcaaaggaggccctgccctttagcccagattcactggtttccctgatgtcagcccatggagtcccaaagccccatttccagtcctcagttgtcacagcaggaacctgcttctgctctgcaggacactggtgggctgcggccatctccaagaaagaatggggacttccaccgttctccagagacagaccctgcagacactgaggagaggttcctggggagaccagagagctgcttccctacttccccttttccatggccctcttggcctgccacaggcactggccacactagccacgggactccccgccagtagcctcctcagtctcaaggctctgccctgtgaaacattgcttctcgcttcaagtcaaagctaaatgcaaacacttattcagccacagtgacttgtctgtgcctcctcttaaggacctgggttctatggggtcacattacctacagggtaaagagagagaaaagaactctagctggggagagtggagaggcaacctggagctgctccttaagggagagagcaggaaagaagcctccatctgggagggagccttgtggctgccgtctggtggcgctctcaggtatttgaggtcttgcgcttgcttagacagtgatctgacccattcactggacaacttcagtgtaagatatgattagacacctgtccttgttttgtatgtgaatacacaatctagatacaagcaataacattgaaacgtggcccttctctaaacctggaaggttgaacacattgggatttctttcaattccaggtttgttcttttagatttggctaagaagtaaggctttatttaaataagcatccatccaccaaatagctctgtgtccgtcaacttcatatcgaccgtgataacagtgactactgacagagtgtacaagatgagaaggacccaggcttttccctccagtactgggatcttttgcgtccggccacctgttcacatctccctctgcactgctgaacaggctacagttggcaggacctgcagccgacagcacgtctgctccttcagcattcatcacttgctgtgcctttgctcagaggggcccttctctcaggttctttggaagaataacccaggttgtacttattctggaattctttcccatatggggcacagattcatattgtgactgaacctctcaggagtatcatgattactgggaccatcagcttgagttcttaaccccatgaggcttacacatgctcgatgctctttagtgtttgttggatgcattagtgcgcacaagatgggaaccaggtgttcgatgagtgagtgaatgcctgcatgagcttccagtttccccctctctacctcaggagagcgcagtgtggttttgtctctgttttatgcaggcttccttcaaatctctgggaatgtgtgtctttgcctcaaaagcagaccaacctaaaccaaagaccccttccatccagactcctgcaggctgttccatcccactcactttctcttctcttttctctcctcggtttctccctctccggctgtgtgcaacatgcctctagttcatccaagactccactccctctacttatccccagcagcgccaggaccagggtgagactagagaggcacctcaggcacaaaagttaaggaggcactcaggctcacagtggtgccagtgtcatctcatgagaagtaaggccatttcgcatccatttcccatctgcagaggctaagcaacagtgggcgtttctaagaagtgacagagacaggcttcttccagggtcttctccctctaggccagtcttcctgccatgtcatggcactgctgcctaagctgactagccagggaggggtgcacaccggcttccctgccccaggcagcctcttggtctgtggctcctcgtggcatggtgcctgctgacagattaaatgaaagcagacacaaagacagggcttaggtggggtcctaccttcccctttcagtccccatcccacaccacgccctcaaagcagtgcccagaggcctccccactccctagtaacaccttcctctttggctcccacctttggctcccgaaaagcctgctgaatgcccgctccttctgccggctgctttgcctctgcctcctttcctgcctggctccccttctctcccagctcctcaggcaccccacctttctttcccttctccatctctcctcctgggagaagtgtggccccattctgcccccagcacaaagcttcacccaaattccaccccaccctggatctccacaccaagcggctcagggttaatggtcgagttcaggaagcttatgtggccttggtcaacacctgctccctcacccccagcctgaagtgaaggtgggctaatggtgggtgcaggctgttccacctggcagatggagctactatgcctgcctcggcgaccaacgcagcagatgcagccgagaagggccccagggagtggagtcgcagcaccggctgccagctgctctcttaattaaggaatgtggggagtggcccctttgaactcaccagctaatttactcctgtgcactcccctctgtggctgggtaattaatatggtgtgaaccagtgattagcaagtagagagaacctgcctgccacagacttaacccttycctgcatctgggaagaaytgctgccttcttagttcgtctttctccagtggtcacatgggcagagagtttttccctttggggaggtgggatatttttcagtctccactcaacctcctcctaccccctttctcagcttccccaaaactcccctcaaggaaaagggcttcgggtgggggaagggctgcaattcattcctttgcttggatggaccactatgggtgaccaactctgcggagtgggaacgtaactgcccactgtcttctccagaggaattcgggacctggctccacattggccccatacctgcatcccacagccctcccagtcctaggctttgacattttagaatcattcaattcaatccaacagatgcatggagggctttgcctcatcgaaagcctgtccttggcaatatacagggtgcagaaatgaaggagatccctcccctcatggagctcccagtctgggagcagagagtcagaacaggggactgcccagcctgaaacatgcctttatctgatttacccaggtttccccacttccctctccctggccatttagtagcaatagttagtatttgagtgctaactgcacccgaccccaagttaaaccttcacatgtgttcattggcagtactaagaggtaggtattgttattgctccccatttcacagatgaggatactgaagcacagggaagttacttggctcaaggtttcacagccaagatttgaactcaagaagtctgaatcatgcttgagttctgaactcctaccctcatctgattgtattcttaagtctcacctcaaacaccaccccctccacagagccctccccagacccccacctgccctggcagggtcaaaggtgtcctccggctctcacagcctccagggcacacatctgacattgttcttgctacactggttataattattggtttatatataccatcttctgtgaactccttaaggtcaggggctragcctttcatctctgtgtccctaggtcctggcacctragtagatgctcaataaatgcctgakgaatgaatgacggaattggcaatggagtcgtaaatgagttccctcccttgccctctccacccccatgacaggcagcttcccagttctgccctttcctcagtactctagacatttccttcatatgcagtcccttctccttctcacaggaccatcacaacagacaacagctgttgttcaggttccctggcccctttgttctctccaacctgccctgcctgctgtcctcccactcctacttaaaacatgcaacagcccctctcttcaagcagtgcttccggagcggtcccccagtccaccagccacagactcacgctgagtggggtgcttgttacaaccacagattcctgggccctagctcaccctgatggcatctctgagaatccaagtgctgaacacagttgagagccactagtctccagaagaacttaacccagttttcaaggcctccacaatctgcccccaacctccttttccattcttcccacccagccctaaaggattcctgtctgctgtcccttgtcctctgtggagcctacttggtattttcccacagccacatccctgcacgctctgctctcccctcctgcccagagcccacccccaacctctggctctctcctttcctcatattatctaaaccatgcccatcttcaaggcacagctcaaattccaccttctcaagaagcgtcccctgcccagatccgcgaagccctctttcccacccacttctgaggactgactacctgtttgcacaaagtggtgtctgtctgcagataacccttcactttccttggtgtacctatctctacattttggttgtgagtacctggagggcaaaaaccttatcccaaaatcctcctgctcaccacccacccccaccccatcctatatgcctagttcctggctgagtccaaagctcagtgtccagtttgattgacaggcgagaggctgtgcaggaccagatacgatgagccacactccagactagcaggaattttcctcaggggcaacacgtcctcyaaaaaccttcactggcaagaaaccaagaaacttgaagtgagaagagaaacaggatgaggaggggataactgtggcaaaatagaccacacttcaaaggctgaggttcaagttccagctctgcctctctgtgagctctgcaaggggcctaacctcactctggttttcacattttcccatttctaaccaggtaacaagatgatcctctcagaggagagttgcaaggcttacataaagccagatgtgtagccatgtctagaatgtactcactcacttaacaaatactcatgaaacatctgtaatgtgccaagcactgagggcaacacagaagggaacaaaagactggctaaacagtctgtgaaaaccagaaaactgtcatcaacaacacagcaagagtaaagagggaggtgtgggcatgcacaggacacaaggagagggcctctcacctgcctgtggtcaggaagcctggaaggatgtcctcgccgactgcacagccatgttctgtttgcaaggatagagggagcagcatgcctagtcggggtggtggggaaagtacaacacagggaagtgtgaaatcagtagttctgagaaggaggccttctggcttgggatggctggagggcagaatgactgtgggcgaccagcctggagaagaaggcctgactcaggagggcctgcatgcagagcagagttagtcctcatcctcaggtccacgggaggccacagaagcattttaagctagaatgaggatgacagatagtagtgaggcaggctgagatgcaggaaggccagcgagatccagcaaggaggatgtggcttgtgtgggggctgttgtcgccacgtgttagccaaccatgtgcatgtgaaagaggctgacttacaagaatctgctcctgtaagcccagagaggcccagggayaacttccactttattctggatgttttcacttttgggacatcctgttctgagtcaagattcctccttctgaacatgggactttccagaaggaccacagctcctcccgtgcatccactcrgcctgggaggttctggaktttggctgtcgagggagtttgcctgcctctccagagaaagatggtcatgaggmccctgtggagtctgcttctctgggaaggtaagtggggcaggcagatagcctgtcctcggagagctgaaggcccctccccagctgcctatgccagacgtctgggcagggatccctcgacctgggtgagaacccagaagctgagggtgggtaggaaagactagaacaagctcttgggcracattttaagctaggcagatacaaagagatgcagggtcctgggagggaggaggtggcascttgaggggtattcttatctgtgagacatgagctgttttgtggcccagagcagtaaaaacggagccagtgggtgatactgctggtttggagagaaagtcggctgtgagaatggtgaggacccggcagtgttagcaygcagaaactctrcagagtttgaggagagtagcagagggcagggcagagcagggttccccacaatcagcagagtgtgttttcaacagcctgtgggggagctgaggtccctccctacaggcctttataaggggaggcaagtactaagtagggatgagagaggctaaatrtggcccaygtggacttaggggtggccgacggtggtgtgatgttgggatggctgatacacggggtctcctccacaccgggcgatccctctatccatctgatgcctgagttcccttccttggtcaacaagcagccaacatgacatgggtcaacactgccgggccatggatgagggtttatggggtgcagcaaagattaagatgatattgtttacatcagaggctcatagggactttgggttgctttgtttcatctccttgcctgagttcctggccctgagagctccaaagcctgcagatttcttcaatatttctaaacatgtgcaggaaatcacaccttaacctcaaaaaaggccttggtctgtttggtgagacaaaaataatttgccttttttttttttctttgagacggagtcttgctctgtcycccaggctggaatgcaatggtgcatctcagctcactgtaacctctgcctcctgggttcaagcgattctcctgtctcagcctcctgagtagctgggattacaggtcactgccactaaacccggctaatgtttgtatttttagtagagacagggtttcatcatgttgaccaggctggtctcaaactcctgacctcaagtgatccgccctcctcagcctcccaaagtgctggaattacaggcatgagccaccacacccagcccaaaaataatttttcaaatggcccttaatgatcaaagatctgtgtgactgacctggtacagaccccttatttttcagtggtactgaagcctggggcagggtgatgtgtggaagggcacacagctgatctgtggcagcaccaggaggagcaggtaggagcagctaggtcttggctgacatccagtgcaattctctttgtgtgttacattcctgctctgcattaacactgaagtcatctccagtgtgagaggaggttgttgggcctggaggacagtgaggcagagggggaccggaattatcatggccgactgagcaaccatccagatcatgtctcattgaccaaaacttcatcacctcttattcttccctacaccctgtgccagygacaggcatagggtcagtcctcagcagggtaggtcatttattcaataccatttactaggcttctcccacagtctgttcttaaacagtggtgggcactggaagcaaacgatggggagaaagagctcacggtctagtgggagatgctgactcataaacaggcaataagaatagagggataagggtagtcagcatggtgrccccaggccactgtgagaacacaagagagaatatgtaacctctcttggttacattacctatgagggataggggaggtcggaggaggcagtgatgctacaagagtgggcagaaattagtcagcaaaggagtcagggggggcacttcaaggagaagcgtctcccatacacgtctgactcaaatatagtcccccaaaacagcatcttgctttctcaccccctgtctgtttctcctcctgttctggatcacagagaataacatccagtggatcccaaggacctgggagccgtcctcgactcctttttctccttcactccccagagctaatctattaccaaatcctactgattacacaccatcttcgtgtttctcaattcctcccacttcttcccatcccggttgctcccttcctcaattcaagttgccgtcacttctccactggactaacatgaacagcctaagtcctgcccacctccagtgcattctccacatccctgctggagtgatctttctaaccatgcatctaatcctgttacgctcctgcttaaaacctacctgagacgccccattgctctacagataaagcccaaactccagtattgctttcaggtctctgcatgatctgactcctaccaactctgcagtgtaatttcctactcctcacacagagaactactctcagttcccctgggcaccaactctccccctccaggcctttgtcagtactgtgccctctgccggtgacacttccctatcctgctccaggccgccctcggcttggcctggctgattcccattcctcttcaaggctcagcttaacaatttgttttctgagcccatcaaggctgggtgagatcccctgtcaccctacctgtgttctcccagggcatctcatttttcccttcatggtatttaacagaattcatttttattgatttcttgaatgtctggcttcctctgtaagttccatgaatgcagagactggggttatcttccatatgttttatccctggtacctagcacagtgcaacctcaacttgagtggagggaatgtcagtggaggggccccaattcaccctatagcagctcagatgcatgcaaaagaaggatgaggagtgtggggcaggcagagtgaccaggggctctgttctttcagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcrgcaacttctccgtgttgatggtggacacaaggggccagccctggacccagaccctccagctcaaggtgtacggtgagtgtgtctgacactggytgcctggccctcttccccmacaaagcaccagacgagcatcctgagtcatagcagccagggagagctgggttccagaaagctctggtctctgaccatgttgccgactcagggaacagctgctccctggcagtcacgtctaagaaaattcctcctggctgcagcagccaggctttgccatttcacagtgcttgcctgaactctagctcagtcttttcttggctcagtggccttggacacaatgcttagcctccctggccttcacctttctcctttgtaaatgggcattgtaatattaccatgtagagtacccacaggatgaaatgcagtggcatttgcagtggcatccaggacagagcctggcctgtgcttcctcagttctaaaggatcatcatagactataagatgtgccactagtctatgtagtctatgtagtctgtgtagactatgtgtcattagtctaaaggaaaaaaaatgatgtaccatactaaactatgacataatgggtttatttaaaaatcaaattataatgaaactgtaattaaaagtatagaatttacacatttcttaaaagggcttcttagagagatcttaactatatatgattcatgggttctctcagtcattcatcattgcaaaacaaaccatcccaaaacttactgactgaaaacaacaacgatgtttacttctcataattccgtgggttggcaggcccagctgggtgcgacttctgcttcgcatgggtctgcagagccattcgcgcagctacattcagcacctcggttggctgcatggactgggggctgcgtgggccttgtttcccaacaactccacctccacctccaccacagccacctccaccaccttcatcatttgtcttctggtcaagaaagagtggctttcagctctcatttatctacctaatgggctagaaaagaggcatgggtgaccctaaatcactgtttcagtaaaaccttagaaatttagatagagtggaagagaggggagtccagatttaagaatggaaagcagaggtagcagctgggaagagggtagccatgagggagataaagattgtaagcaaattggggagatgtcttgaatccccccaagasagctaactggctgtccttgggcgagccactcagggtgccratgcaattgcaaggtgcctttctggatgcacgcagccctgagcctcatcttggcaagcagagtgctggctggatttcagcaccccccaccccctgccacctgttaccctgtgaccccccttagcccaatgtccttgtgtagtgaataacctaccccaccatacaggcagccctggagcccctcctctgatctgagtctcagctgccgcacatgtgaaatgaggacattgaatgtgataatacatgcagcacccacaccactaagctctaaaatgccttgttctcagcagctgaattacagattttaaggaaattgctgttttattgcttccaaatacatagcgtgattagaactaattgcacgaagctgccaagcagccgtccttaggagttctgctttgacaatagataagaacgatttgaattagcagatcagttactagaaatgtcaatgkgtgtttctactgtgcttgatcgtgtttggaagcagcttgtcctcttaagtgatgtaaatatcccccctgtaatctttgtttatactattagtgtgcccagcaaatcatttctctttcatatcacaaatcccaccagactgaactggcattaacgaggtttttctctgcttgactttggaatgctgtcagagactgagccctcctgttgtcaccagaatgctctcccactggcctcatttccactgagactcaggatttactcatcaacctgtatagaaaggggaatccatggctaggacaccaggatatcagtttgttcagtgaccagatatcgagcacccactatttgccagcactacagagctaagtttactaagctaacaagacagagcccccacctctgggcccctccttcacagcattttgcaccctcataattatttaattaattattcataatcattttgtatttgtctttctcaccaaactgtaagctccagaaggctaggaatgtgtttgttttcttgcctgacttaataaatgcttgtcatctcttgttgactgactgacatattgtgagagaaatactacaaaaagagatagagtgcttggagagctcagagccatgcctgggaaggcttcacagtcaaggcattaagcaatgtgttcaagctgggccttgaaggatgggtagaagttttctaggaggacaagaagggaaaggcatctgtgtgcgcagatgaattatgtgaaagcatgaaagatattcaagagcatgacatgtttgggaaaactgcaaattaattaggatgagcagggagaagcagcaggaggtacagctggagagatgggcatgaatcgtttcctgaaaggttttgaatatcaagctaaggaattcagcttctgtcctgtgggcagtggaaagccagacaagattttggaacaagagaggcctagccagaggtggcatctaaccctgggtagatcccagagccagagatgtgggccctgcccagcmtccctgagacccataccagctgtacttttctttcccagatgcagtgcccaggcccrtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacrgacaggtgctgagcatttccctgggaccaggagacagagatgtggcctattcctgcattgtctccaaccctgtcagctgggacttggccacagtcacgccctgggatagctgtcatcatgaggcaggtatgctaagggccagcagtcagtggttgarggcttatgaagcatcaagtccacctctaaccccacccctccatgttcagcaccagggaaggcctcctacaaagatgtgctgctggtggtggtgcctgtctcgctgctcctgatgctggttactctcttctctgcctggcactggtgcccctgctcaggtaggagtcctgcaggtgcaggaggtaggtggaggaagtggagttcctggggaggagggggtcttggacctcctcctatttaggcttcagatggtctgccccttcctacctctcccacctcatctcttggccttctctagctcatatcttggtttacaaccagactcaactacttgaagtctcttatgtggttctccaaatgaactgttctctcacatccatctgcagacctttgtacattgtattccctctgcctggaacacactttccatgatttcccacccagcctccccccttcatgtggctatctcatactcagtcttcaaggtgtgcttgctccagaaagccttccctgattgccccaatactcaggctgattaacatcctttcttcaatctccattgcttaccccaatcagagaactacttacatttacttccccactgaattctgagcccttaaaaggaggatgctgggtcaacactgggcatgtcagtggttcccagaacacaactcttcctgaaacatagctggtatcgacaaacattgttgagtgggagtctaaatgactccgaaccccttcttgcctgagatttctacaaaatggctccctaagataagctactccctggccagtggctgatagggttgccttcttgagaagaggaaggaaggggaaactccaagatcagacctggttctaagctctacatacagctcagtcccttcctctgccgcaggatgccctgcccctgaaagaactacccgactgaccagggctccgtggtcatttccatgccaggctgtcggagctggcttgtcccaaggtggagaaagggagtcagcaaggaggagtcactgagccctcactatggtgggtgtgtcccagaaggcagggtctgggtccagcctctaagcatggggacaggcartgctgattcctgttcattctctccagcagagagaagggcaagagggaacagctgagcctgcactccacctgaaggccccatctgctgtgggagggtattgccctggcccctggcccctggcccctgccccaagagtccccaggatttgtgataagaaagtggaagccaggaaaacagcagggaaaaaatasctttattgagatataattcacatagcatacaattcacctatttaaagtatacaattcgatgccttttagtgtattcgcagagttgggcatccaccttcacaaccaattttaaaacatttctattacctcccccaaaaccccataaccccttagccatcacctcccaaatcccccattcctcccacagcactagtctgctttctgcctctatgcttttgtctttcctggacatttcatataaatagaactatacactatgtggccctttggccaggcttttttcacttagtgtcatgtcctcaaggctcataaaatagcatctttggccactgagaagggacccaacaacctgggatagtagaaagctccaygcagggagtccagaagctggttctggctctgcctcatggcttctgtccagtgatttaactgggtccaccacagtcctaactttccataccttctacaattaaatgtatggcatagttgcaggccaaggttagatactaggaagaatttcctattcttgaagagcctccctttccagggtgttggaagaccaggagaaatgttcctttacctaaggtgaccttgggctaacacactgaggattcagaggcctgcaggcaggccaaggattccaagactccaaacactrgaggggtaactttctttctgatgtccttaccagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttcccagggtggcttcaatctccccacctaggatrtcagccctgtccaaggaccttccctcttctccccagttcctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatsagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatgactcacttgtcaactagtggactaattaaccctccaccaaaaaaacacaaagtgcttctgtgagaccaattttgtgctaatgagcattgagactgatgctttgtaagtcacaccacaacaaatattgattgagggcgctgcatgtgctgggtacatttcttggcacttgggaatcagtagtcaagcgaaacccttgcctttgagagtttatggtctggataatataaataaacaagtaagcatatgtcagatgttgttagtttctgttaaagacaaggcagagtaaagggctagagaacaatctgttggggagacagggtctgtcttagataaagcaatcagatgacaccctcaatggggtgacatttgaacagaggcccagtgaagtggaggagtgagcatgcagtgacagagtgttccagacaaagagaccagaaaatgcaacggccctaaaatggcagcatggttggtgtttgcaaagaagagagtggaggccagaggggctggatccaaacaagggagagagaggggaaggacaagagtacagagagatggcctggggccacatcatatgggacttcgtcggaatgcccctttgttggagttacaatgacagaaagaacccctcgagagtccagatatcagactcctcccagaacaccctctacctcattgctccaggatgcttgtggtcaggtgagagccctctccagatcttcttttgcttttcctcgttttcactttattttccttgagcaatagtttttgcatctgttctcctgtacaaaagacaaatacaagagctgctagggcaaagggctcatgaaacatgatatcagagagaataggaaaggggaatagcataagaaaagggttagagaggacatttttctcatcaatggagacatgaacattcagtgcctcatttttaaaaaaactgctgcatgagctgagattgtgccactgcacttcagcccgggcaacagagtgagactccgtctcaattaaaaaaaaaaaaaaaaactgctgcaaacattaatgacacctgtagcaaatctttcttccatgtgtattaagaactagcacctgttcagttaatcactcttggttacttactgatcttcagaggaagcatcatctccttccagatttggcttcatggctacctgcatctgttctgcatgcagcctgaaggaagggcctctaaaatgacaaaaaataactatccctagatctaggaaagttatggtggctgcctccccttgggctgtgccttagtcaacattatgtgccaggaggggcaggctgagcacacgggtaagtagtggggagactcccacagcatgactagtccaggtccaggtctcgaagccacactttcaggaagacactgaaaaactggagtgtctggaagagaatgaccagaatggtgaaaagtctaaaaaccttaccatatgagaaatgattacagaaactggttatgttgggcctagaacaaaacactcgcaggagcataggttctcaaatatttgaagggttatcacataagcccagaccatgtaactggggccaatggagcatatcactaaaaggcagatattgactcatatgaataataggatcttaaagctggaaggaaatctgtggttactcagttcaagtttttttatttctcatgtggaaactgaaatccaaagagaatgttactcctctgaaattacataattagtggcacagtcagaattacctttagattatctaaatcagtccagtcccttctactgcaccacactaccaaggaagaatgttctgacaaatggaaaaatccaaatatgaagtaaactgtttcaatgaatctgcttaagcagaaaccatctcagagcaatactttagaagatttaaaaataacaggaaaacacttatatcagtcagggttctttggaggcaagcaacagaaaccaactctggttttaactaaagtaaaagaggaaatgtattagaaagatgtgagtaactcagagaaccaaggaaaatgttgaccgagcctcagaaaagacaaagccaggtagccttgaggatgcaggcctcggggcctccgaaaatagttctgttctgttttctcttccccagttgctcactgaagattcaactccccaccaacagagcctgattggcctatttgaggccaagggccctcctctttgatggggtggggaggagctgtagaacttcttgtcagaagcattaactgggttaacaaaataaagtacaaaacaaagtttgaacaggtatctgtagaacaggaaatgcacccatccattcattcagtaagcacttactatgcacctactatgtgtcagcaccaactgggatacaggaattactaaatagtagcatcacaagccctgccctcaaagagctcacagactggtaagaaagcaatgtgtcaacaaaggattccagtgagttcacaggcacacagcccctagcatgagctcaaaggcacctcctggcctgtaagacctcagtccccaaagacagccagtcaggtccccacgggaaacggtaaaaggagaaagcattgcctgggaataaaacttcagctggcaggaactgaagacagcatggtatggtggtgtcctggggcaggctttcccacagcagcatcacacttttgtttaactgtgttccctgaacaccaggacatctcatgctggtagcttgtcttcaggtttcccttgagatggtacagaaaagggagagccactcacaagggctaggggctggttccatcctcctggtggtggttagggtggtcctggctgggacgcctggactgagatgctgatactgtctcatctgccagcccaccctgttggtcttcaagcctgtacccactggctggacctgcttagactcctcaggagtcttccaaagtcaggtaaagccatttaaactctgtctaaccagagagaaaatgaagaggtcggagctctgtctgctggctgacccactcaaccatatgcccacctgcagttaaccactcaaccatacgcccaccttcagttggcttaactgcaggagctcagagctccagcatactcactgcagtcctgctcccagaccagggagccactacccccgctcccaccccccagcaaagaagacacaaccagttggtagcctggacctctctcttcgatgctcagaaataccctgggatccctcctgcccctcattgataacaacctgacagcctaacagtcccagaaaatccctaacaatccacagacacccagggtgctggatgcctcctgagcactgagcacagatccccacacgtagggatgcctccgcatgaggacatgagagaggcagatggtggaaggactgaccacaggcctggccactcccagcagaaggacaagaagtgcaggggaaggcctgagcctcttggcttacctgttgtcctgaggcctgggcagtcaggagaaggtagagctctcatccatgcactcacctgagggaagtctacaccagaggccagagtcaccagccagagcctcagccagctccagccagctgctaatggagcatttattcttctggaggctgcgtctagaaaggacaagcctaacaggatgcctgtcggtctattccctacctgattaccccaggaagccacaagcacagacaatatcacccctacaccaaggcaagaaggctgctgccctggcctgtactacagaaaggcagctctggctctcctccataggcaaggagacaacggtgcattcacccgtagctgcctctcccccttttagatcacacttcagaaatacagatgggaattctgaagatggactaaaatgcctacctgtatcctgggtctgaaggtagctgaggggcagtttatggacaaggtgtggaggaagcccaggatgtgcacagctgtgggcacaaggctcttcacagtgtgggctggagctgcaggtgagaagagaaaggatctgatttaaggcctgggcaagggagccagttcttcctatgctgggagttctggtatgaaaccccaaagagtccaagatttctgaatccaaacctggccttccaggtcattgtgaaggtatatttgtcaagctaggagaatagaacatattttacgtaataatgtgttagctcaacttacaattacaaatgttatgggtgggcctcaatatgcggacccctccccctggactttttccatcataattccctcccaccccctgaaactgacacctcccccatgactaagagcaaacccccagctctcgctgcagctcagaaggagcacagcagtgtgggtctggagtcacactcaggacagcgggctctgatttcctggagaactgattcgcgggtccacagcactcattctctcagcacgtctttagtgagtacccactccatgccagacacactaggaatagagctgtgggcatgacaggcgagtctctgcattcatgaatcttgcagacttgtcaggcagaaacagacactgtacaagtgtacacaaatgtttaattaaaactgtgctaatctctatagaagaaaatagctgaaaaccaagagccagaataacaagggatcaaaatatagctggcgggagtacagagggaagggcctccctgaggaaggagagtcaagctgaggccagtggggagaggaggagtcagcaaagcagagtggaggagctgccatgctgggaatgagcatccatgaaagcccttccagaaagatctctgcctgtgtaagcatctgggggaaggtccccagggccagagggcaatgagcaggagggactctgggaggagaggacggcagaggtcagatcatgcagggtctgataggacatggagaatttaaaagttaattataaatgtaaaagcagaccactgaagagctttaagacaggaaatgacatgatcagactcacattttaaaagatcacgctggcagctgcatggagaatggattgaaggtgccgagagtgaaggcaggaaaatgaagttattgcaggaatcctaggaaaaaaccatcatagcttggaatgaaggtggggagagagagggagacaagtggatggcttcagtgcatatttaggagctagaagagaatagacaagacttagtatccttggttgagggaggggtcaaggatgacactgaggtctctgacatgagtaaccaggcagatggaggtaccatttaccaaacctggaaatacagaaagagttagttttggctgggcgtggtggctcacgcctgtaaccccagcactttgggaggccgaggcaggtygattacctgaggtcaggagttcaagaccagcctgaccaacctggagaaaccccatctctactaaaaatacaaaattagccaggcatggtggcacatgcctgtaatcccagctacttgggaggttgaggcaggagaatcacttgaaaccaggaggcggaggttgtgttgagccaagatcacgccattgcactccagcctgggcaacaagagtgaaactccatctcaaaaaaaaaaaagaaagagttagttttagggtgaagtcagaagttaattgatccttaattatcagggaagaggggctttaaaaggaacaaattcttggaggctgagcaatatattgggttgaatcatatgaaaatttcattttttaagtgtaaaaatagtcaaacacaggtaatttcatatgattcaatctaacaatttaaatgtaagatgacttgaggaagaaaagtcatctcttcagctgccctgactccacctcctataaggacaactgggacatgcctgtaacctagtagatgttggcagagctccttcaacatgaacctgggcatggagggactgcaagacaagagggcctcccacagcactctcagcccacactggtcgggggccatggtgtcctggtcagcttctctaccacctggactgaatcctgcctgcccagctccagaaagtcctgaaacattcaggagccaaggttcagaatggcagggagtgatggaactgcctcagcaaccatggagaactgtccttgaccccaacccctctgaatccaacccacctcatgcctagtcctgcagcattcagagccccatatagattgtggaagtgaggcccctgatgctgtctgaggagcctttccaagcaacaggggcagtgacttggccaggcaggcatgg

SEQ ID NO: 12393 - DNA, 157953 bp, Homo sapiens
  misc_feature (1)...(157953): n = A,T,C or G, or insertion/deletion polymorphism (see Tables 1-2)
tgcttcttagtgggtggatctgctagtaatgaattcactcagtttctgtttgtctgaggtagtcttaatttctctttcattttcaaggacagttttgctgaatatagaattctaggtctgctcttccttccgttccttttattactttgaatgtgtcatcttactgccttctggtctctatggtttctggtgagaaaacagttgttaattttattgaggattctttgtacatgaggagttgcttgtttcttgctgctttcaagagtctctccatctttggttttagatagtttgattatgatgtatctcagtatgcttctctttgagttcattttagttgacagtttgattatgatgtatctcagtatgcttctctttgagttcattttagttggagtttgttgaaatttttggattatagattaatttttaaatcaaatttggaaaggttttagtgaatatttttttctgcacttttatctccctcctctccttctggtactcccaattggtactagatatatcttagcatacttgatggcgtctactgatctcttaggctctgttcatctttcttcattgatttttcctatatgttcctcagactaggcagtatccatggacttatcctcaattttgctaattcttctgccactcaatcctgctattgtccccctataatggatttttcatttcagttattatacctttcaattacagagtttctttatatatagttatataattcctatatctttaactacactctctttttggtgagatattgttctcatactttcctttaatttttgacacatggtttccatcagttctttgaacacatttataatagctaattttaggtcttcgtctagtaagtctacaatttatgcatttttaatgacagtctgttgactgccttccagcctgtgtccttttctgcctgtttatgtgtcttacaactttttgctaaaatatagacactaaaaataatgtaatgtggcaactctgaaaaccatgtttccctttcccccagggtttgctgttgttactgtttttatttctttgatgcctttcttggactaattttgtaaagtctgtattctttgtcatctgtagtcactgatacgtcactgtagccatttgtagtccttactcagttagcttaattgttcactaatgatgagagaaatgctctatcattcctcaaatgctagaatcaaagatttttttttcctttgtttatggtgggactatgtgtgcatattaatgcatgccttcaattttcaggcagacaattcacagctttgcctcagccttcacatcctgcttgctcaaagcctcacagttagccagaagtaaaacctgggcattctcagatttccagaaatatgttaatcttttttttttttctgttagatgagatcttgctatgttgcccatagcatagttgagatcttgctatgttgtccagtggctattcacaggtgcaatcataacacactacagcctcaaactcctgggctcgagtgatccttccacctcagcctcctgagtagctgggaccataggcatgtgccaccaggcagcttatgttaaatctttttaatgccccctccccatggacatctcattcttcatttttctttttcaagtttttcagtcagcctattgttagctgtaactggtgtcactacctgaggctgctgtaatattaaacaattgttactgattgttttcaacaatgccctgtggagaggaccatttgcacagggcaagctctgagttatgccaattaaagacaaaccctgggaatgtagcttttccaggaagctgccagacaagtaaatagtgccaagactctggggatggggctctttcaggtgctccacatcctttttgtccctccagtggctgctagactgctcttatggttgcagggctgttggttttcaaggttacacatactctttcttcttcttcttctttttttttttttttgagacagggtctcactttgttgcccaggctcactgcaacccctgcctcctgggttcaagtgattcttgtgccttaacctcctgagtagctgggattacaagcatgcaccactatgccaggctaatttttatatttcaagtagagacagggtttcatcatgttggccaggctggtctcaaactcctgacctcaagtgatcctcccgcctcagcctccccaaatgctgagattacaggtggagccaccgtgctcagcctcaaggttacacatattctatgtagtcgtccctcagtatccatgggagattggttccaggacctctggtggatatgaaaatccatggatgctcatgtcccttatataaaatggggtagtttttttcatataacctatgcacatcctcctgtatactttcaatcatctctagattacttataatacttaatacaatgtaaatgttatgtaaatcattgttatactctattgtttaaggaataatgacaagaaaaaaaagtccatacaagttcagtacagatgcgatttttttttccagacatttttgatctgtgatttggttgaatccatggatgtggaaaccatagatttggatagctgactgtatccctacaaaaatatcctgttaaatggcctgaagataaattctcatgtaggatggttctagtcctaaagataacactgttcacctcttaattattgtatgtagataatctgaatcagcttgcagcaggtcgagccacagacaaaactccttgacactgagttaaagaaggaaggggtttattcagtcggcagcaccggcaagactcctgtctcaagagccaagctccctgagtgagcaattcctgtcccttttaagggctcacaactctaagggggtccgtgtgagagggtcatgatcaatcgagcaagtaggggtacatgactgggggctgcatgcacgggtaatcagaatggaacaggacaggacagggatttttacaatgcttttccatacaatatctggaatctatagataacataactggttaggtcaggggtcaatctttaactagcaggcctagggcgcggcgctgggctgtctgcctgtggatttcatttctgcctttcagtttttacttcttctttctttggaggcagaaattgggcataagacaatatgaggggtggtcccctcccttaagcttacttattgtatatagatcatttaagtcagtatgttcatcagaatcccttggagggcttgttaaaatacaggtcacttggccccacttctagagtttctgattcagcagatctgggatggggtctgggaatttgcatttctagcaagttctgggaggatgttgatgtgactggttagggaccccatgttgagaacttctgaaggactgagatactttaccaccagcatacttagctatcacatcgtgatgcttagggaagatatagcatgatattgtaaaccaaaaggtgtctgagacagatctgtcaatttagaggtttattttgccaaggttgaggatgcaactgggaaaatgaggcacaaactacagtaggatcagtaggatctgtggcctatgctttttcccaagagggttttggggacttcaatacttaaagaggaaaaagtgggcaggaggggaaagaagaacagtgaattatgcatttttacataaggtaagtaaacagagagtagaggaagaggtcaaatatgcatttgtcttggggtgggtggaaggatgattcctccgcttgtctttgtcccattcctgtgacgataagctgttaatttacattgtcagggtgagggaggccacctggggagatatgtggccttctatcttgcagctatctctttaggaacaaaaggaaggcagttttttttgcatgattcagttcccaagcttagcttttccctttggagtagtgagtttgggggtcccgagattttattttccttttacagtattaactaacacatggctcccttttctcttgataattttcattctacggtggaattagggcctcattctttgccacactgaaaatgtgattgatctttgaagattatccagaattacataacagtcaagtgacagatgttattggaagctgatcctcattcagtgttactgtactaaatgaatgaatactgaaattagactgatatctatttttaaatctttataaatttaatttttttttcttttttaaaagttagtgtttaacaactttcttagcttgattatgactgccaggcgtggtggctcacgcctgtaattccagcaccttgggaggccgaggcgggtggatcacctgaggtcaggagttcaagaccagcctgaccaacatggagaaaccctgtctctactaaaaatacaaatttagccagggtggtggcacatgcctgtaatcccagctacttgggaggctgaggcaggagaattgcttgaacctgggaggcagaggttgcggtgagccgagatcgcgccattgcattccagcctaggcaaaaagagcgaaactccatcccaaaaataaataaataaacagcatggccataaaatttattgtttgaacaggaatacatttgagagtgaaagagggccctattaataattttgctgcaaaaagatgtaaactggggctgttccaagcaaactaattggtcacagtaattaaaaaaaatgcaaaaatatttttgcatttctacaaatttgattttcttggctttaactttgtactgtggagtcaaggttctgtcaatatttctttccatttagctggagaaataataagagggaactgttttattactaagttacttttcagaagagaaataaaataaaaagtaaagaaataaaaatttaaaactaggacattttctttttcttttttcttttcttttcttttcttttttttttttttttttttagagatacagggtgttgctctgtctcccaggctgacactgcagcctcaaattcctctgctcaatcgatgctcctgcctcaggctccccaaaaaactcgttttatatttgtttatttttattccagactattgtctgtattttggtgacatgaggaggatcagacataattctaaatgagttcagagaattcttaatttccattcctaactggttaatctcttttgtttttgaagcaaattatatgtttaaatgctctgcctgagaagtattctggtttattgaattaaaatcattttaagaatttttttttcggataaaatgtgaagactcaaagataaggatacattcagtccagtatttgcccttgctcaaggagaaatgctgttttaaagtcaaagtgaaaattttcttccaaaacttctgattattgtttttgtctatggaaaaatagaaacttggggcaaagtgtaaggactgatgctgttgcaagtctgttagtgcacacttatgcacacaggccagaacaggtccggaaggacatacacttagaggttagcaattttcttttttttgcaagtctgtattttcaaagaattaagattttaattttttgcttgtctggttggaatgttcagtttcctaaacatctcctggggagtgagtacgtctgcacttcaggaagtgctcttgtccggagggcaaaaggttgggggcgcatccccgggtcgcggctcctccaggaaactttcccttggggatccgtcagggcctcagatgcctcagtggatgacagggtgaagatgccatcgctcagtcaagtccagaagttcaagaactccttgcaggtgaagcagtcacaggatagggtgggatcttgtgggaacctagcagtaggaattggcgcgagcagctcggtcaccggccctactgtctcagagggcggacccagctcgggctggtagtggggcgggggtcgcagggcgcgggccgggccctcagcgcgcatgcgcgacaagggggcggggccagggcggggctgcgcccggcgtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccaggtaggtgggccgggccgggcaggaggcgacgcggccgccgcgggggccggggccggggacggacagcgggcgcgggggcgcgtccaggtccccgctggggcggatgtggacggcgcccgcggttttcatggaaattgcactgcctaacggtgccagtggtccacctgcggtggcgtcttttgagaacaatccgagcccggccgacccccagccccgtgaagacgcggccgccccagcagggagccgggtgccgagcgggcgcgtggccgcgggacgcagacgcggtgcctgcccgatgcggctccagggctgggtctacsggctcctgaagctggaggccttgccgtgtttggggtggaaacataaccgggtgaaagtaaacatgcatctccgtgtgggaaatctggtctccatcctcgaaactcttccattttctgcctgcctttagaccccgacaacatttctagcatctttgctttctatattttatttctctctggctttgctagtcaattaattgaggcctgagaaatgtgcagggatctgtggctgtctcttgaaaagccagccaggaatgggtaggccccagaagacagacgttcaaaatgtcagaggtaaatttgtgtctttgtgggcgaaggaagggaatgttgatggtctcgcttcccttcccctgtcgcctgccctctgacattacataatgatgggttcttcctgccccgagttcatccgtaatgacagaccatgaaaatgttcctctgggtaagaaagacctatatgtggtagagcccatcttctcttttgctttgccactgaatgtgtcttgtgttgggaacctgcctaagagtggaatttgatttgtcgcctgcccctcagggcatttaaaccaagggaatgggggtggggtggcgatttgggtgttgcagagaaattctgactggtccatctgttcacagtgggttgtgtggaccatggggaagccagtggggttgaggacagagtgggttgacttcggtgtgaatcatggttctgccgcttgctgactctggttcttatctctaaaaggtgagagcagagccttttttgctgagtttgttttggaatctagctgctgttggcgttggccagtgcacgtagaattgcttgctataggttgtcctagaattgagcctaatttttctttggttgaaaaacacactttctttaacggaaattttgtttttggatctaggctagggcatttgttttgggggttctttgctgaagtgtcgactgctaatgtactgttttctttgaagaaagatgaatgatggggcccatgtaagaagggcagtgtggttggtctgttgcaggagtggtgccaggaggccgtgatgctgtctgtcccaggggtggcgttgcatgtgaacgggcctctcggtgcctcattccctgtgatgtctagtaaacacgcctgtgaagccagagctgcttggtagagtttggcttgaagaaaaggcttaaagaaatggatgtggacaaattcaaagagaaagaaacattgtgtttctactgagctccttatagaattagtctgcttacctggccaccttactcatcawgtagctacttttttcatttagattattctgtctcagggtgtttaatctgcttgggtaagtcttgtttcccaactagattcagaaccaagggcagatattatagtgcctccctgttttcaaaactggatattttgtagtattgctgttaaactgaatattagcgtttttwaaaaaaawatcactttaaggaaggatgaaataaaataatacacgagagctatttgtaaactgtagagcactagaaaaatgggatgtgtatgacagagaactatcagccctgcaagtccctttaaccagctgcctgcctaagagggagcgttctcagccaacatctcttcaaatgcacacgggaatggacctgaaggcggtgtgggaccgactgccccactgatccccagcccagggcttaacatctcaagagttcagtgaggcagagtggagggggaggctttccaccaagactgtttcatcctgttttcgtttttaaatgaaaagctccttttyagtttagtattccagaaaagttgccacaacatcatcaactactcatggtgtcaggaggctttgactttcactgagaaaaaaatagcacaaatctgcagcraaaaaggcttgattatgttggtgcttctgtagaacttgattaatgagctggtcttgagagagccttcgaaacggctttttttttcagtgtcctaaaacagaagttctgtgaggaaaacatattttgaggagaccaatattaacgcccatgcaggcttgcttcattttgtctctgtgtttttaaggaaaataccatcatgaagctaatcccagggaatttacctatatttctattcatatgcacatgttattctctaattttttttttttagtattwtgatatagtttcagacttacagaaaagttgcaagaataagccaaaggtttctcagattctccaaatgtggacattctgttacactgctttatcattctcttgtattcctgtgtgttactactttttcctgaactgcttaatagtaagttgcaggcttgaggcccttttacctctaaatacttcactgtgtatttcccaaaaaacaaggatattcataacagcagtaatccccgcactttgggaggccgaggcgggcggatcacaagatcaggagatcgagaccatcctggctaacacggtgaaaccctatctctactaaaaatacaaaaaattagccgggcttagtggtgggcgcctgtagtcccagctgcttgggaggctgaggcaggagaatggcgtgaacctgggaggcggatcttgcagtgagcagagatcgcaccactgcactccagcctggaggacagagcgagactctgtctcaaaaaaaaaaaaaaaaaaaaaaatcatggccgggcgcagtggctcatgcctataatcccagcaatttgggaggctgaggtgggaggatcacttgagtccaggagtttgagaccagcctggccaacatgatgaaatactgtctctactaaaaatacaaaaattagctgggtatagtggcgtgtgctcgtagtccgagctacttgggaggctaaggcatgagaatctcttgaactcaggaggtggaggttgcagtgagccgagatcacaccactgcactctagcctaggcagcagagtgagactgtctcaaaaaaaaaaaaaaaaaaaaatcatgaaattaatgttgatataacactatttagtgtacaggtcgtatttagattttgtcaattgcttcgataatgtcctttatagcaaaagaaaatcctagatcatctgttttgcattaagtttttctgtctctgtagtgtcctttaatctgaaagttaccacgtctttcttttgtatttcacgacatagacatatttgaagactactgactttttaagataatgccctcaattgggtttcctgtggtttcatgattagattcaggttatgcacttctggcgggagtagcacaaggttgaagcagttgtagtcttcttttctctctctctctctctttttttttttttttttttaaagagacaaggtctcccttcgttggagtgcagtggtgccatggcagctcactacagcttggacctactccactcagtgatccttctgctttagcctcctgagtagctggactataggtgtgtgccattgcacctggccaatttttaaatattttataggggctggatctcacactgtgttgcccaggctggtctcagactcctactctcgccatcctcctgcgttggccgaccacagtgctgagtttacaggcgtgagccactgtgcccgamtaatgctgcagccttcttaatgtatcccatcaggaggcatatgctgtgattatcccattctctggccctgctaactttgatcacttgaattaaggtggtgtctatctcatggaaaagttaccatttttccctttgtagttaatctgtgtcttaaaggaagagaatttgagactatgtaaatatagttactgctcatacaattaactgactagtttcagaattcattgatgtttcttacctgagtcaattattatgatagtaggcagatgatgattttcatggttccttctatatttattagttggaactgtactgaaaggaagaaaccttcctttctctattatttactttttgatttacatcactggactcatgaattcttgctttattcaatagattatagtccattactcccattatgcattttgttgctcaaattatcctagatttggccagtgggagtcccttcagtctggcttttgtgtccttttgacaagtgctcatcattctttgaggacttttcttccaggcacaaaatcttcaaggactcagcttatactttccttgtcccagccctggaatcagccatttctccaaagagtcctggtttcctttagtggagagtggtataaaaaccgagatgtaggcactatgtattctcgttgctactgaggtgtcacccattctagaccttctcaggggatagatgctctcattgtaaacataaatgtagtcacattacacaaaattttctgtggcttgctttttaaatttgtactccttccattaggctttgaaactgtctgtttccctttaacttggccaacatttaagagaataaatcttgttaattttgccaatctaatgggcaaggaagacattattgttttaattgcatttcccaaattaccaaaaatattggataccttttcttgttaatgtatattttaacttctaatgaattacctgtttatatcctttgttcattttttcttgttgggctgtttttccttatcttactagattgtggaagttacggtaactttgaattttattcttggcagctttagaatgtttttttaagtgtgatgcttttttaatttttttttaaagtcctaaatgacaaggaacccaagcttttctgagtaccccctgcatgccaggcctccctggacatcctgtgggaggttctgtccaaaggtgagctgtggtgttgaggagtggttagagcatcccccgagggtagttaaaagaggctcaactgggactaaaacccagttatatcacctaacttccttcacaggattgaaaaatgaaagcttttcaatgagggataaaaattgattacctggatttgccagtatcaacaatttctgttttcagtattttggtttataaatcaggaatttcttttacacagtcctttttgctgagcatacacatctttcgaaaccatttattttatccctagaactattgtggactctggtgctgcactttctgtgagcatccagctagctgtgtgactttgggcaagtggcttaatctttctgtgcctcagttatttcatccacaaaactgggctgctggtagtagcagccccagaggcttgttgggggattaaatgaattaacatttaatcctggtgcctagtaagtgtgcagaacggaagcattacaatggattcgtatacagagtgtgggtggttggcagagcttggaattagatcagcctttcctctgtggatttaatctcttagttgtctctttctgttttttttgagatggagtctcactctgtcgcctaggctagagtgcagtggctctagcctgcaacctcggctcactgcaacctccgccccctgggttcaagcagtactcctgcctcaccctccctagtagctgagattacaggcatataccaccatgcctggctaattttgtatttttagtagagacggggtttcaccatgttggccaggctgttcttgaactcctcacctcaggtgatccacccacctctgccccccaaagtgctgggattacaggcatgagccactgcacccggccttagctgtccctttcaccatagcctgtctgggattggaaagccagggtcctgggtgcagtgtgcatgtctctttctggtctttgcacatacctttgtcatgccctatcaggctgtcaggcccaggcctgccagccagccagcccagctggcctctggtgtttgcccacagccctaacctggagcatgggtgagactgctggccttttaatatgaaacttgttcagtgaggctcacctggcgagggacttaggcacagtaagcagatgtatatggtgggggcagtggggggatcatgctctggtgaggtctattttctggaatagggtcaggaagacagggatgtcctctgatgtccaggaagaagggtggggacctctgaaagaggaaagtgtttacccgctgccagctccggtcctgggatcctcctagagcgctttccctgagacacctggtagttttcctgacctccggttgctgyagcgcccctctttttgcacctcactaggtggtattctgatgtctcctgaaaaccccctgcccctttcctgcccctcccatagccctcacgcaggtggtgtcagctgctgttatggaagctgtctattattaattcaccctagcatattgaacgcccttctttccctctctcatgttgcttgcatctctaaakggtgtattctcaaaccaattaatttgaattttcaagaaggatgacctaagtgtataaactctggaaatgtgaaggaagtatttaggcagatggttgtttctgggaaacagggctctactaggaaacaaggatgcccagttcaagcttctccctggattatggggtgtgtcagttgggatgcttttggttgccaacagtgacatttattatctcagagaactggagtctccatcagcatgtcagcagtttcatcaaggacctcgattctgctcctctgtccagccatcactgccggtttcatcctagggggttagtctcctcatgattctgagatggtcgttgggggcagtgggactgcgtgcttccttgttcctgtccagcaggagcagggaaggagacaaagcagctgattccccagccacagtgtctaccagtccttccctctggcctgtggagcaaagggtcacgtggccttccctggaccagcaacatgaggctgtgagagtgctgtgtgctggttggcttaggctggtggtcctccaggtgtggtcctcagaccagtagcatcagcattacctgagaacttgttagaactggagattagtggatcctaccccacccactgaatcagaaactctgggatggggcccagaaagctgtgctttaagaagacttccaggtgattctgatgcaaggtcacattggagaacagctcttttagtttaatcaagactcccctactccccagctggagacagggctgacttttcctgaggaccggggaggaggttaggtcctagaatagcaagaaggaagagaggatggtgggtggccagcccacagtgtgaactagccagtgtttacggccctgggggccgctttgctctccggagtccttcccctgccccccattcgccagcttgtccacccatataagtttctcagcccccttgcctcaagcttctscagctcctccaagcatggcctgtactctccctgtacarctcggtgctaaaggaagcaacctcagtaacactccagctccaggtccctctctggcctagcagggatggagtctacctggctggtgctgaagagtcccaaagagctgttatgactcaccttctgaagccattcctgaagtgtgttcatttgtgtaggggttgcctacgctgctactccttgctcagctaggaaaaaagagcagtgcagttagtaggtgcttgagaaatatttagggaattggcctggagacagcccaagtgactactttcagtggtgatttttacctgtgttatgtccccttttttgcaagtacaactccaacttgatgtttgggtgaaataaatagccacctccacggtgtaatttgtgagatcacaatgacccacttttccgaatttttcctgaaactaaagagttgagatatttctgggttttcagctttaaagattcatcttaatacataaaaataacgtttaggagtagtcttgcactgagctctaaccacattagcactaattattgcggaaggaagggcacctgaggaggaaacatgctagagaagggtccacacagcatgtttcaaaatgcartggttcatgaaatcartttgaggttgtaactggcattaaaaagctttttgaaatagcaaatatccaagtacgtttcctatgggaaggataagcattttttggtaaaacatctagttattcacatgtagtgtatttggggtgttgttatggtgtgactgtttcttagagtggattttggtaaagatgtgtcaaaccctagggctgagtgcagggggtcctaacctgtaggaaggtggggcctacgctggatgtgtatacacttggggtcttttcctgggcgtgcgacctgtgacttttgtcagaacctggtggtctgtgactcgccatagatcaagaaccaatgacctaaaaccagaggagactttcagtggtgagggccagtgggagtggagctgggggcgtgaggagcaggcacaaagtcctgagcctggtcctgctctggcrtattgttcgtggtagtaagccatctgagccaaatcctcctgatgaggagtcctctgcacagccacactgacagacaggagagacagtggcaggcagtgtgttgatcacctgaggtcgggggttcaagaccatcctggccaacgtagtgaaaacccgtctctactaaaaatacaaaaattagctgggtgtggtggtgcacacctgtaatcccagctacttgggaggctgaggcaggagaatcgcttgaacccaggaggtggaggttgcagtgagccgagatcacatcactgcactccagcctgggtgacagggcaaaactccctctcaaaaaaaaatttaactctggatgccagatgggtcctttacctaacaggtggatcagcatatttctacataagagagagagagagagtctccttgtttggggctggccccagtgaaagcattgctgcttttgactccccgctggaatcctctgtgccttaacactgtcaggacagttcccaaggctggcttagagtcagctatgatccccattatttaatgcaggcgctagtctggtttgtatcacaaagcttatgtagtagtggctttggcatgtctgtgtttgttttttgggggtaggggcaagttggattgtagtgctggatgtgaacccaagtcagctttctcatctgtaaaatggggaaggtgctaggctcacaggagggtggtggggattgataatatacataggagagggctgtgaactgcagtgcactggaccggtgcaaacatgaatgtttcgacccctgctccacttgacagtcttggtaactgttttccccacagtactcttatttttcacatgtgctcaaagggctggagtacaccctattgttgactcctgctcagggtaccttccaggggaaatatcacagaagagggaggtgctgagaggcagggacatccagcgaagttgagaggagaaggatgtgggcggggggtgggaggaggaagtggagggcttgcactctgtaaactcttagtcagctggtcactgacccaactgagccttttactgacactgtttttttaaagaatggaaggactaaggattgtatgagctgaaatgttgagtattttcacatttcttattcattcttcgtgctctgtgtatacaaatgttaaatgatcacattacataattgggtgatactcaaatggcaatacagtggtatgtttgacagaacccaatgttttaaaatagggctaggtgccaagaaatgtcaggataggctgagtaaggtgactcaggccagtgatcccagcactttgggaggccaaggcaggaggatctcttgagcccaggagttcagaccggcctgagcaacaaagcaagaccttgtctctactaaaaattaaaaaattagccaggtatagtagtgcacacctatattcccagcttcttgggaggctgaggcgggaggatcacttgaatccaggaggtcgaggctgcagtgagctatgatcgcaccagtgcactccaacctgggtgacagagtgagaccctgtctctacaaaaaaagaaaaaaaaaagataccccagaatcttccaaatattgtcattcctatggtttggaagaggggagtgagtaaatggattggccttagggacgacaccttgctggtagactgtgcccacctcaggtagaagggaagcgctagcagtctcatttgtggtttgtccccaacttgccagtgacttggtgaagtcatgcctgaatctcaccctcctcctttcttgttcatctagtgaaggtgatttcctttgttcctcccccgtcgaatcctccctgacagtggaatggagtggtgatagtgcccaggggctacatgggtgaagtgtggtatgttcttgatttagttggcattggactaagacacacacacacatacaagtgtctatttagggaagttgttctttggtctgttgccttggaaatactgcctttttattctttcactttctctcccctctgcagtgattcagcagtagctttctagagaagaagaaacatagtgtcagagaccctggagtaccaaggatatgtcagtggagagggaagctgcctgtgtgtcacacagaccacattcttcctggtccagctagagcgtcccgtgcctttccttggcttttccagcctctctccatcactccttctgaggccctttgcagacagtcccccagtacaactacagcatttttgtaagtccagcccttgtcattttcccattgactgatggagaccacttgactccagcatactttatgcacacttatcttctggttcaggtctggactgtctttctctttctggcagctttctttcctgttagccattcctgacttgtttcaaaaaggatacatggacttgaaattaccagttaaagcagaaaatgattaaaaagaaaaaaagggcttcaaatgtcaaatggatacaactatataagttgtagaaggtgctctgaacacgttacagggaggttgccattgctaaaagcttttacattttttatttatttatttttagagacagagtcttgctgtgttgcccaggctggagtgcagtggtgtgatcatagctcactgtagccttgacctcctgggctcaagcatcctcctgcctcagcctcccaagtagcaatgactgcatgcgtgtgccaccacacttggctaatttttaattttaattttttctagagactgggtcttgttgtgttgctcaggctggtcttgaactccgggcatcaagcaatcctcctgcctcagcctcccaaattgctgggattacagggcatgagccactgtacccagctacttttacgtttttcattctcacccctttcttctggaaacactgcagagaccatgagaacaggagcttgtcttacttgatagtgcaaacagtcttacaaatagtgttcaaccatcgattgcccaaaacacgtgttttgtgactrttattgtaggtgcctttgaactgtatggtgtgttaaataactccattggagggaggaagatctttgtgttttgagttgattatttaattattctttaattagtctaatgtctttaccaagctagatattaatatcttttgtcaaagagagaagaaagccagtggatgggttgtgaagtggtgaggggccacttcacaaatggtgagtgggtgggtttttatttccagcagtgtcactggaaacaactttgtaccaacttgcatggtaaggagcattcaggttttaaagttaatctcattcagtttctcctgtgggacaacattggcctttctcattggggatttgactgttgggccttgtccctgggtatgtcccagcccagacactcagggcactggccaccctgcctcagcccctctggagcaaagagagttttaagcagtagtggatgtaactcatttaaaataggattagatctagctgggttagcttagtggcatgcacctggtgaggctgtattctctagctacttgggagaccgaggcaggaggattgcatgagcccaggagtttgataccagcctggtcggtatagtgagaccagcctgtctcaaacaaacaaacaaaaacaggattacatgagctatgactaaattccagggcagtaactgctgtgtcattctttgggaactggtcatcccaggatttgatcagtgtttcatatcataggttggctgttttgtaaactattaggattgtaccagtgtttgtcatgggaactagcagcctgtgacgtagactgtgaacctaacttaattgactactgtaatgaatacaaacagttgctatttttacctcagaacgtagatttgtctgcaaattaaacatttgagacaataaacaggagtttggtttattaaagctgtttgagcttgctacttaggcaggcctagaaataggattggctagctttttctgattatgtagatgttgactatattagggagaaactcttatttttgttttattttattttagagacggggtctcgctctgttgcccaggctatagtgtagtagacagccatagctcgctgcagcctcaaactctagggctcaagcagttctcccacctcagcctcccaattagcaaggactacaggcatatgccactgtgcccagctaattaaacaaaaawttttttttttttttttttttgtttaaatgaggtcttgttatgttgcccaggctggtctggaactcctggcctcaaatgatcctcctgccttaacctccgaaagtgcttggattgcaagcatgagccatcacaccctgcctaacttaacgtttaaacaaggcttgagcctgggcaaaatagtgaaacttcatctttactaaaaattaaaaaattagctgggcatggtggtgcacacacwtctgtagtcccagctgctcaggaggctgaggcaggaggatagcttcagcccaggagttcaaagttgcagtgagctatgattgtaccgctgcactccagtcttggtgacaggggcttgcctctgcctcagaaaaaaaaaatcatcaaatagccctttctcaccttctctaccctgggagtggctacggataggcagcaactgaacacaacacgtttcctggtacccaagatgaatcattgctgcctgtgatgcctgagcctagtgattatcttccagattgttttgctagccagttctttctccataaaaacattcagattttttttcctctttgagagtggagtattttacttgagggagctgaccaccgaacttcatagaaatgccttcctgccccttcatggctgtgctgttctgtgtgttttttggggcttgctttcccattctgctggtatcctgggtgagactctggcccaatgaatgggatgctgcacattttttttccaggagaaacaaaaggtgttgggacccctaagtatgcagcatgtatgcagagagtgaggcatggccaggggggatgtggctctgatttccacattgcatctccagaccttaagcgggtaggcagcatcggcggatcatggcagggagagaagtacagcggaggcgaagttctcaaagcatggctgactgtggaaggtggctctcagcacactctttgtggcccgctaacacccgtcaggatggtagccaccacacgcccaaaggcacccgaagtgcttgattttgactgacttttaccacatttgccaccagtgtgattggagcattcatggagcacagaatatgacaccaagtcaggattgcatagtgctcaggcagagctttgtccttcggaaatgccgctcactcatgagacaagatggatagttcaggtctggactggcccaggagtgggagtgacactgagtagacctcggccaggggcttgcccctaaaccagtggtccctgcacctgggaaaatcagcactctgattgcctcacctggtttcccgcccactcctccctaccctggttgagtggcctaagggagggtagagttcagggagctattaggaggaagggggtcgctgctgagtagccaaaaggaaaaacaacatgaaagtaagaaagtctaccaggacaccctggagggctggcgtgcagagtgctgagggggacacctgtgtccgtgtttgggaggccctcttaccctctcctccttggtgtgcaactggttaatagtaattccttgagggtctggagaagttgctcaagtgttagattctactttactgcatgctacaggggcattgtgtcccacaatggcattcacagtgtgaagattgccagagttctctatggacacaccctgcgaacatcatggatctgggctgtcataagacttaagcatccttcagggcagggacaatagcttggttttctttgtaggtccagagtgccccactgtgcctggcacaaaataggcatataatcaatgtttgttgagtgaacgaatgaataaagctagtctgtccttgtcaaagtagcaagaaaagcctcagcctctcttgggaagacagcctgcttccctgaggtcaagttgaggttcagtctaactgaggagaaggaggggagaccagaatccactgcacagctgctgccccagtaagttctcagggagaaaccagaactgtcagtttgctgagtcaaaggcagaagcctgttctcagcagtgaccttttttatccttggcacacaagcccttttgtccaggtggctggaacctaggtctgcttccacttctgggtgagaaggtgccacacctttgggtttggtcatcgtgtgtgtgtggtgtgtgtgtgtgtgtgtgtatgtttaaaattaaaagtaaaaattttccccatatacatgtacacatatatgcaagtgtggtattataggtgcaagggtgcagagaagcctagtagggtaggggcacccaggaaaggtggcctcttcctcttgtgggttttggggagcatcacagggcctcagggaagggtgagttatgtgtcatggaagggcagtggctcaacctgggggtcttcagagataaatgaggagggactggggcaatgcatcaggaaggaggctcaggagaggcagggccagatcacccggggggctcgagccccttcaggccttttgtaaagtttgggaattcattcatcccacactggagggtgtcagacttttttaagactctttcattctttttgtttgtgtcattactttaagtgacagaagcagttccatagtcattttcrtggtttggggagaccctttcttggatcatagtaattcttacaataatgcctgtgctctaaccaccagttttaggggattgtgggccgcgacttggcctccttgtctccgctctgtgttggctttacagttgtggatgctgcggctcacccagcgctgtgtggcagtgggtcctgctgcaggatgtccacaatgcagaccacagggcagggtgtccctggcacccatggggtcaggggtgaagctgttatctgtgaaatgacagaaatgaaacccagcattggagaagaatcgtctgcgccccctctaatccacctgtgaaacactgtgctgaaacaccatgaggaagaggaagcattggggtgtaaagaaacccagaaatgctggtttctagaaatggtattaattgtctcaggggctctccctacagtgtgaaatagctggctgggcagctgcagccggttccatcttctccatagccacgcccttcccgtgacctcatggggtatctgcacagtgggtgcagtgcaaaaagacacagtcaagcctgtgagccagtagctggcgagggggtggtttggtagtgagagatgattacagggacgggggttggctcatggttctgccacaccaccctccatctctaactgggactctgacttggaatatagacttcactatgccacatgatgtagtgacatggcagaggaggcaaacagagtggaaggagacaagtcagagaagaaggaagtgaagggcggagagcaagggatgctcattgccaaggccgtggcagtcactgccagcaacaggtgtgggcctagctttgattctgtcacctgcaggggtgcctgccccagagcagggctccttgaaatcttccatccccttattggctgtgcactaatgtctcttggagagacttctcaaaaacctccctgtacttaacttggtttgacaaatttgataacattttatgttttaataggcaaacattttcatggcttaaaaattgtaaaatatagcaggatatgtggtaaagcctgtttcctaccctatcctctagccatccatgtcccctcccttaagacaccaatgccatgtgcttgttgggtttttttctgaagttatgctgtgtatatgccagcaggcctgcatgtgcagacatgagacagttttccacatccctggtgccatgctgcgtgctcgctgtgtgcctcttctgacggtttcactggcccacaaggagttttgtgttccattgtccagctgcatgctggcctgctgccaggctgtgctgcagattcttcaaccagtgctctctggatgcctgttagcytctttccagcctgtgcttcacactaatacgttagttttgtgaaggaagctgcaccccccttgctctgaggtctgggcctaggctctggctggattgagcatcattctagctggaaaaagagggtggggttagacgacgtgtttaagcttctgcccgtttatttcaattatgacctggcctgtagggttttctttgggaaatgggcagttaatggttagatactatttgtaaggcacatgtctctaaaatattaccttctagtggccaggcgtggtggctcacgcctatgatcccagcactttggaaggccaaggtgggcggatcatgaggtcaggacatcgagaccatcctggctaacacagtgaaaccccatctctactaaaaatacaaaaaattagctgggcgtggtggcaggcgcctgtagtcctagctactcaggagtctgagataggagaatcgcttgaacccgggaggcagaggttgcagtgagccgagatcgtgccactgcactttagcctgggcaacagatggagactctgtctcaaaaataaataaataaatagataaaaataaaataaaatattaccttctagttacacacagaccttttatttttttaattattattgttttttttttgagacagggtgtcactctgtcaaccagactggagtgtagtggcaggatcatggctcactgcagcctctgccttccaggctcaagtgatcttcccactttagcctcctgagtagctgggactacaggtgtatgccaccatgcctggctaatttttaatttttttttgtgggtttggctatgttgcctaggctggtattgaactcctgggctcaagcaatccacctgcctcagcttttcaaagtgctgggattactggtgtgatccaccatgtccagccaacacacagacattttattttttatttatttttaatttttaattttttaaaatttytattcaagacagaatcgtgctctgttgcaatcttggctcactgcaacctccacctcccgggttcaagccattctcctgcctcagcctcccaagtggctgggattacaggtgtgtgccatcacatccggctaatttttgtatttttagtagaaacggggtttcaccatgtcggccaggctggtcttgaactcctgacctcagatgatctgcccgcctcggcctccgaaagtgctgggattacagacgtgagccaccgcgcccagcccacagacattttaaactaacctgtagcatcctgagtgaggcttgtcaaagctgcttttgaccccagtttcaggtacattggctctgttgggctttcctctgcctggcctatcaagcggccaactcaagctgcaggtgcaagggcagatggttctgcagggaccttaatgacagccaggcccaggaacacacagtgcttgtgtggaagtctacatttcagctgtgatggtgtctcgctgaggctggttctggccatgccctcccagcatttcagctgttccaaccaaggtgctctacatctcagagggaaggcaacggcctgggcagcacgttgcacgtacattttggagtcatgttggttggtggtcttcagtttctgaatctgtgatatggcatggtcattcatcacaggcgaggtgatgcaaagttaccaactgggagcacacctgccccttctcattcactcacgcagcaggtagttttcaggcacaaaggaattgacttgtggagctggccctggggtctgtctgtaggagagcaggaagtagtagccacctgcggagggctcacaggcatgtgcctgcgagactgcttacaagcccctgtgcgggatttagggcagaccagagccatgagcgtccatggtcaagtgaaggtctggtaggtgtgagctgttagccctagggtctgctgcatgcggtgccaggggctgaggaatgctgaggcagcttttcctccagtctctgctcgctccgtgcacagcccttgtctcctgcctgatagtggtcagtagtcagttggcttagggtacacggtctccacccagtgaacctggcgctggcagaagcttgtagaagaatgggtgcaaaaaagatatctcagagggcctgcagatggctgtttttaggaagtgaataggcttcttctttttcttcattttttctttaagatactcttgaggttttgaggctccaccctgagctctttgtggctgagggctgctgtggcttgatgaaggggacagtcttcaaatcttgcacaggctggggaaggttgggacagcacagccctgagtctcgaacaaaatggggcagaggggagggcaggagagccgtcagattcatggggccacatcctcgcagcaacccaggggaagctgaggccccagggtctgcatgatggaggccgagcacgacggaggaagtggaattattgcacatggtgggtttcgacacttgggactcgctcctcaaagaggaaaatcgagagtgggggtgcacagagcaagggctgaagaaacaaaaagcagggggtttaggggagagataaacctctttgcatgagtcaagctgaaaagcagtttggaaggtcaagtgctagccagtgtctttttttgcctgcccagcctcttcttctgccatgtctgccctgacaggggcagagttctcagttcccatgtcagaactcggcaccagcttctctgttgacagttgcaaggcctgtggctgagagaagtacttgtgctgtgtttctgcaaggtaagatggccctgatcacagctcatgatgcctgagatcaggagggtctgctccatgagatatcagcagaggccatcctgtgaaatattttaactaattgaactgaatgttgaagacaaggcctgtggcagtgttgtatttatatgtgacaagccgagagtccttggacaaccttggaaactcctttttaggacagaatcaactgagacgatacacacgaaggagcttttgtgagcagagtacagagctcgttattgcagtacaaggttgtaggttttcacacagcttttgaggatgggttggtggcccagggaggatgtcaggaactgtccttcactaatggggattctcgagttcctaccacgtgccagatagcgtgctgattgctttgtatccacttcccttttaatcccttgtattagcttcctgtggttgctgtaacaaactcggtggcttaaagcgaaaggaacttattctctcactgttctggcctccagaatcactgggctgaatcaagctgtgggcaaggccatgttccctccagtagcttagggcggaatccattctgtggctgctggcttgcctcggctgccggccccttcctcatcttcacaccagcagggtaacatcttctctccgtgactccgcttctctctgcttctgtcacacggccctctcttctctccgaaatctcctgccttcatataaggacatttgtgatggcatttggggcctaccagtgtaatctaggataatctcatctcaagattcgaaacttaattgagtctgcaaatcctttgctgtataaggtaacattaataggttccaaggatttgaacgtgaacctcttttgcagggggcattatttgacctgccatacctcacagcagcctgatgaggaccatactgtcccacatacagtgggcttaatgaggaagctgaggcttggggaggcctaggggtggccatggtcctttcctctcccagactctggggtagctgactctggggtcattttgtcatgttgctgggcactcacttggtgaacagataatcccctgtcattttactatgttgttacatgggtttgaaaaaagagtttttcaactctctggctgagcccctgttcctgtgagggcctgtggtttttcctcccggctccaccctggtttcggcgcagtacttgagcagacggtggcttgggtctcactctagcgccctcccccttcctctctggctgtgtgcccaggctggccctgcccaccttgctcagtctctgctccatctgccacaagtctcactccagccctccccccagtagcttaggaagggaccttcttgttacgttttttgttttgttttgttttttgtttttttgtttttttgagatggagtctcactctgttgcccaggctggaatgcagtggcgtgatctctgctcactgcaacctctgtctcctggattcaagcgattctcctgcctcagcctcttgagtagctgggactacaggcgtacgccaccatgcacagctaatttttgtatttttaatagagatggggtttcaccatgttggccaggttggtcttgaactcttgacctcaagcaatctgcccgccttggccttccaaagtgctgggattacaggcgtgagccaccgtgcccggccttgttatgttttttaagctaaccctgtagagcactcactgtgcaccagcacctgttggctcaagggggtgacagacattccctatcacagattacaatgagtcaccggcatttttggaatttcactaagcgtcgttgctgtgctgtgcctcagcatgcagcacttcatttaatcctctggacaccttgaatgataagtgtctgtcatcccattttacccgtgagagaattgcggctcagagaagttgtcacccagctggttggtggcagaggtttcagaggtctttctgtgcataaaaccctcacttatggttatgccaggtaggccttggaggggatagacccatcgccaaactcacaggagagagaggagggcactcacaggtgatgatgtctatctgtcttctttctggtggggacccagagttttatttccatctcgttttctttatgaatgcttgtctcacacttatgtattttttgggcagtccctgaataactacaccaggcttctgaatgccgagtttcttagagtagccgggaaagggcctttttcttttcctcttggatgttctcttagtctgttttgtgctgctataaaagaatacctgaggctgggtagtttttaaagaaaagaggtttacttggctcacaattctgatggctggaaggttcaagactggacatctgcatctggtgaggcctcaggctgcttctactcgtggtggaaggtgaaggggagctgtcgtgtgctgagctcacatggcgagagaggaaggaagggagcgggtggtggtggtggtgtcccaggctcttttcacagccagctcttgtgggaaccaacggagtgagaactcacgcaccctcaaagcggggggtggttgggggagggcattaatgtatacatgagggatctgcccccatgacccaaatacttcccattaggccccacttctracattcgggattaaatttcagtgtggagtttggaggggacaaacattgtcctcttgtgcctgtgccacacttgcccctccgtccccctcatctgctgatgattcatcacactgttaacttggtctctmcatctgtttaaacgctttctcctttcccctattatgttgctgttaagactgtgaagctgtcagcaatgttagcgacaccgtccacatgtggggacaacaggtccagtgaacctagcatcatcagtgtcctttgcccttggaactgagtggaaattatcttctcagcctccatggatttaacttctgtgttcttgatgtgaagcttcttttccttaagttagagtttttgcatatacatcccacacatacacttgcatttgattttcttgtctgtatatgcacacacaacacacacttgattttcttgcaccataataacgtttttctgattttaaattagaaaaggacaaatgagttgaatagttatctattagttatagataattatctattatctaattattatctagttctctatttaatagttatctattagttattaactgtctaatagttatttatttcttgggaacttaagtaccaacttagtggtaattttacatgaaatgaaatgttctctgggttccagataacttataaatgggcttttagagtacagcctgttggttgaacaggccgtaagttcagcctcatctttgtcgagttccacaactaagttttacaattatttatgaatgatagtgcttagcatactttccaactcagtgagaccatgaactaattgaatttgtaataaccctgagtaaatcttagtggactaatagtaaaactttgaggttttacagtaagaaagtgagatccttagatataccaattttaatgtctcagtaaagaaaacaattttattgattgattgattgattgagacagggtcttgctctgttgtctagtctggagtacagccatgtaatcatagctcattgcagccttgaactcctggacttaagtgatcctcccacctcagggttctgagtagttgggagtacagaaatgccttaccatgcctaaattttattttttatttttttgtagggatgggggtcttgctttgttacccagggtggtcttgaacccctggcctcaaatgatcctctcaccttgacctcccaaagcgctaggatttcaggtatgagccaccatgtatggctgaaaacagaaaatttataaggtgccactaggggagggtaataaaggaaggaaggggaatgaaatccaaaccaaaataaatgctgtttagtgtgtggctggtgggtcgcatttctcattctaagaactgtggcatttctttttgatggttctgttgatcctgaaaccagtgagactgcagtttgtgaaggatgatgatagaagtcgataactcctcatggttcattgctggaccatgagtttagctgtaactagatgcaaagctcatggctgagattgagagccagagagacccaaagtctctacatcacgcccacactggtacttccagcctaggaggcgtggtgaatgcctcccacagtggttgctgagatggctttgagcagagcagagatgagtcaaccatggcaggataaagtgaacagctgggaaaaggggttttgggggctgggggtaaggggaactggaatagtgttgcaattttccccatcctggctgtaccttaccatcacctaggggcttttgaaaaacatggcagcctgccctccacccatgctgtgctaattagtgtaatcctgggtggggccagcatgacatttgccacctttcccatgaggtgatttggaggtacagctggggtggagagcagtgggccttagaggtttagaacccagcctcctggctgggcacggtggctcacgcctgtaatcccggcactttgggaggccgaggtgggtagatcacgaggtcaggagttcaagaccagcctggccaagatggtgaaaccccatctctactaaaaatacaaaaattagtcgggtgtggtggctggcatgcgcctgtaatcccagcttctcgggaggctgaggcaaggaatggcttgaacctgggaggcggaggttgcagtgagccgagatcgcgccattgcactccagcctgggcaacagagcaagactccgtctcaaaaaaaaaaaaaagaacttgggccgggtgcggtggctcatgcctgtaatgtcagcactttgagaggccaaggcaggcagatcacctgaggtcaggagttcgaggctagcctgaccaacatggagaaaccctgtctctactaaaaatacaaaaaattagccgggcgttggggcgcatccctgtaatcccagctacttgggaggctgaggcaggagaatcccttgaacctgggaggtggaggttgtggtgagctgagatcacgccattgcactccagcctgggcagcaagaaagaaattccgtctcaaacaacaacaacaacaacaaaaagaacttggcctcctgatgaaataggcccacctgtttcaaatccccacatattggtgttgagccagtctcttagatgccgagcctcagtcccctccttctctcaggctgtgaaggtgaactgtgatgtgcagagctgcagcatgttctgctgtgcaccaaggagggttccacagtcatagaggcatagtcatgactgatgtgaaagggccaacgcacgtgacctcctgcccctgtccgtccacatctcacttggtaaaaccacagccctggttctggccacttctcagcacagtggcctgtggctggagaagaacacatgacatgttgatgagtctgtaaattcatgaccacagagctccagtgagccattgggagtgcttggcactcagagtgtttccctgtggtcctagactggggagcggcccctggattttaaagagctctggacccagtggtgcaggtggggagacctggcccctggaggctgacccagtgcacgtgcagccccacctggggttcccctgattggactcctgcctcaggaggggcatgagactcacttggcgctgcttctgagctctaagtccttgctccttagtggtctgtcccttccctccgcagggaggcatggcccgctgggcttcggcccctgcaaggaggcctggtggggcctttcgccttctcagccaggcactgaaggagcaggaaggggaagcatgataccaggaccacaggaagaagtggtgctgagttgggtggtcacttccttggtgtgacctctggttagacgtggttcagggccatgttgcaggaggagctggaagacatttctttttttctttttttttttgttttttgagacggagtcttgctctgttgcccaggctggagtgcagtggcgcgacctcggctcactgcaagctccgcctcccgggtttaagctgttctcctgcctcagcctcccgagcagctgggactacaggcacgcaccaccacgcccggctaatttttgtatttttagtagagacggggtttcaccatgttagccaggctgatctcgaactcctgacctggtgatccacccaccttggcctcccaaagtactgggattacatgcgtgagccaccgcacccagccactggaagacatttctaaagaaaccatcaccatccttctctgaataggtttcagtgtggttttatgtttgttgcaaccttgttgacctgtagtttcagaaaccagaatggtttggcccaagcttttgatttgagatcacactaaaatagttttagctgagggtgttggaggtgcctcctgtgtatatgagtgtgcgtgtatgtggtgtgcctgtgcgtgcatgcatgtgtgtgtctgtggcttcactgtagatggccgttgtgaatgatgtcctgacctgagtcctgtgagaaacactgttgagttacttcacagtcattccacacaggagaaaaggatgaatgaccctgttgggttaaaaaattgagctttgaaaagcttttttccctttgtacttggcaatctcgcaaagctatcaggagagaatgtggaattaaaatatatagcaggtgggagtatggttttttaacttacacttaaggtttctgtggtatctcatcatatgtggaatatttctgttagaccatctgagaattttaagctctggtggatggaagtaaggttgcttttgaacagaagtctgccatgcygctgcttctcacaggctgcagcctcaggttgagcgctcaggaaccaaggtcaacgctcagtgtgtgtttgccaagtagactgtgtagatttgaagtgcttagactggctgtctgtaagcttttaaaattcttcatttaataatctataaatgtcgaagcctcccaagacgttgctggccctgttagtaagtttgccgcagccccctagccgccaggagtgcccgagaacccctgttggggctgaagtcacagacagcaccgtggagttcgggactgtagctctgaaattctgccacaggccaagcaaactgccaggggtgtgtggtctggggtgaggactgattgaagaagtaacaatcttggatgactttgaaaagctctgggagttgccattgactgtgatgttgatgctgggagtgtgctggagggccacctgtccttgtccctctttttgtgccccacaaggagggtgtaggaatcaagagtttcagctgggcattggtctgctccaacaaggcctctttttgatctcccatgtgactccattttctcgttctctcctgtggctgggcctgtttctgcctgccgtggagcagaagtatggtycacatgggkggagacctacaggggccaaggagggctgggccttgaaagtgatgagcttgagtccctgttggggtccggggttgggggaagggcacaaggtacacagctgggcttgacccagccctgctcctgggagttccctcagagagtgcccagagcagaagagtctgtgctgtgagcacacccacggcagcgtgcacagactcgagtcccccagcagattctcttggctgccctggatggagatasggtgaaactctgctggggagagcacagtccagtggagaagccaatctgatgtggacagatgagctctgtggcaagtgtccaaggaaccaggctggtggtgcagatgtctgtccccttctgctgaagtgctctctctgtcatgcagctgttcttcatgtgtcctctgtcctctggaagatgacttcctgagggagaggccacagcacatatgtctgtgtcccctcccctagccccagcccagggctyactgagggtctgtggtgggtcttcaaatctgtgcatcctcagtaggaagcatctgcagaaaggaggagtgaggtttgagaacctgatattctcctcttacagaagagggcattggggcccagaaagggcagtgacttgcccagagtcttgcagcttagctggggcatggctggctgtggagtccagcctccaggcctccctctccatgaggtgctctttcctgctgccctgagctgcacttctgcttgccacagtgtgggagtgccctaggcaggagaaaggagtgtattgtaggtgcagtgtagagtgaggagggcagtgcgggtgcagtgtagagtgaggagggcagtgtgggtgcagtgaagagtgtggagggcagtgtgggtgcagtgaagagtgaggagggcagtgtgggtgcagtggagagtgaggagggcagtgcgggtgcagtgtagagtgaggagggcagtgtgggtgcagtgaagagtgtggagggcagtgtgggtgcagtggagagtgaggagggcagtgtgggtggagtggagagagtggagggtagtgtgggtgcagtggagagtgtggagggcagtgtgggtgcagtgtagagtgtggcgggtagtgtgggtggagtggagagtgtggcgggtagtgcgggtggagtggagagtgaggagggcagtgtgggtggagtggagagtgaggagggcagtgtgaggacagtggagagtgagaagggcagtgtgaggacagtggagagtgttgagggcagtgtgaggacagtggagagtgaggaggacagtgtggggacagtggagagtgttgagggcagtgtgggtgcagttgagagtgtggagggcagtgtaggtgcagtgtagaggggctgacaccgtgtggtgggccacctgcttcccctccttactctgggcactggccatgatgggttacaatgtggtcagggcctctcaggaggtgccactcagtgagtgacctcacccgggccagatggtgaccataagccggttgctacctctggagtcttggtgggtgggcggatggcacccagggtcacacagcattaaaaagtggatccaggcctttagtatcttgattttccacttcaccaggtgattgcatgaaaacatgttggaaaggtaatacatgtgattggggaagataagtttatttactgtgggacattttcataacttctgtttgagggcattacatatctcacataattacatgctatgaaggtattacctttggtctcattcaaaaattacaaagtgatatatcgagaagaatcacctctcccactttgccttccagttcctctccccagaggcaagcagtttgcccagcatttttgtgagcccttcgggggcagtctgccatatacagacayggacgttttcataccctctttcttctggagtgtgcattcgtttgagcagcttgtttggaaagctgtatatgcaggttgtgaagtcacttttggttttgatttcagcctcccattctttccctttctgcatttgtggtatctaatatcacyttgacagcctcaagagcggcctgtgtgtgtgggttttggtgtccatggtgcagtgggcgagggccacccgcagccttcccagtgcttggtgaggcccaagagtggattttgttttttgaagcaggattcttacacaaaaggacatctctgaagtagttggggttgggagcttgctttttgctctattgtgttgtcttctctataatgtggaatatcttaaagatccagttccacctgtgctacgaagagccctgggtgggatgagcccacgctggcaccacatggccgctcaccccacaggcattatggggagagccagagcaggtgaatggcctgcccgggccctcctgcttggtgagtgacagacaagacccaaaccaggcttctggccctagccctgggcctttgttgtaccttgatgccctgggaggcagcagacccatctcacctgggtgccatcaccctgacatttggcagcctctctttgcagattgccatcagcatcagcctaagtgaggtgcaggaatttcatagttacaggttggtgttttttaaaaaaattctatttcatggataaaaacatcttcaaataagttttcttatgcaccaaacccatctggggccctgggggatacaaaagttatttttaattaatcacttaataaaagcttatttggggctcctgcagtggctcagctttgttaaagatgaagagttaaagatgacttaggcccttctcctaaggagctacaggagacaagggtgtacactgtatcagaakttttttttctttgtggcaacagaaagggccatgtcacaataagcagagggtatttatttctgtctggaagtgggtgaaactttacagggaaattgctgtttaaattggtcatgtagcatgagtacaaattgtcaagcagacaagaacaggaggggcactcttaagtggagcggacagctgagcaaaggcatagagagggcacttgtgagatgctgtcgggagcagcttgtgagtgtggtacttaggaagcttgggagacagaggagggccaggagatccatcctgggtgcaacttcatgctgcattctgtgtgtgccgagagccacagaggggatttaagccasggagttattagcccattagatttacaaattaagagagacctctaaaaccccatgggcggtgtttcaagttctgaggtcatctttctttctcagctatttaaatttgtctcttgaccaaccaggatgacagatgaggtaggagagggagcataagccttggaggaaagcaaaactatgggtaacacagaagtagtcagaatatagtgcaaaatacatttaatctggctgaaattacttgtaaaatttagcaggacattgaacatttacagatactttgtttttttgctttaggcgtcagtattacattgcatgaccaacaatggttgtagtctcctgctgtttgctggggcatgctgggctgtgtgggcagggctggggttcagccaccctctcccttctacctgcttttctcacctggggtgggggctttgggaggaggggagcagtactacccatagtgggcagggatgggcctctggggcggggggagcctgtgtgtccaycttgcctgccactaattttaaataacagtgtggaatgctgttataatggtttttattttaaatttttttccacaaatgcactatcttctcatttttttatcaaggctaatctacaaatgtttaatccacccacaggtaatccagatttgatgcagaattttactgaaatcaactccaaatagctttgtggtaacaagtctttgcaatgtgattttgcctatgtttttctccttaatgagtcagacttgccacatgaaatttttaccatcccaaaactttttgaagaatttaattagaatgggtacataggataatgaagattcacattgtagaaacttttaaaatttgagtttcgattgttcctggaattttaatttctcttatttggtgctaggtgattcccagttttagggccaggtgttgccaggacacacaagccagtgatagtttgactaagctttagggttgtatattaaagtaatgcctggctggatgcccagtcaaactaagacatgctaagctccacatttgagcagtaatggccctgtttgctgtccctcgggagggttcacacccaggagctcagagcagggactttctcctccagggtgggcccctcgctctggggaagagctctccttcaccaagccccctttaggtatctggtctccagccacagtcagggaggctctcagctggggtgctgggacccagccctggggtgtgtgtggggaggagccctgcttgggggmggggtggcgctcctggagacctctcctggctcagaggggagtgatgggcattctgaagcgtgtccagcagggcccacctccctctgcgctcatggtttccacagtggtttgcctcattcaccatcacctgagaatggccaagatagccttgcctcccttcctgtcttccagaaattctcatggggccctccagcccgttctcttcctggcctgtgacgatagcgggttaagtttgtacttttaacagtaattaaccttcttcaaggccttgtttgcygttataagtgttccctgttctctgggtactcacagccccttccttgctgtccttgatccagcggcatggcctgagtgcctccatccccctgtttctggatggctagaagagcctctggggtatctgattgtcagatgggcttagcaggagtggtagtagtaatagtggcaaatacttaagtagcatttttgtgcactgggcacatttagagggattaagtcatctgattcttgcagtaaccccatgaagtagatgattctgtaacacccatttcaggagcaggagactgaggagcagaaggtgaaatgagttctccctggggacgtgtagcgtggcgggtgagcggcagttggggttggagcccggatggtctggctctggggccatgcacagcatgctgtgtgcagctcccccgccgtcccgtctccctgagctgcctgcttcaggcacgcttcttggctctttgtcctgaatggtgtggtggtacagcttggtcttcctgcctggtagggaaaccatagccatgggagtcctagtactgagcaagtgactgttcctgacccgtttccagattctaggggcagctttacagcctttctctgagatacttggacaccatgttaccagaccacagcctaacaacagaggatgaaccagagcctcaatgtcggcgagtcttgggccattttggctgttgattgcctctctcctgccctgtatctccaggaactgtcaacgttggtcttgtagaaactgctctctctttgtgagtgaacaagaccatggctgtctcagtccctccgttagtgactatccttgttcaacccagagtccaggagtctgatgaacagaggctttctccctctacctcaccctgccttttacctctccctgccctgtgtgggtcttgcccaggagacagcggttggatgagggaggagaggctaagggcccctctaatgtggacagcctgggccctgctgtgggaagagagccacatggcatggattggaaatggagagggcagaatttgagtcaggaggaccaccagcagccgtgctagctcttgaggcctaggtcttctggcctttaaaatgggactggagtgggaggtggattcagtgcgagtgcagtccctgcggcctacaacctactgttattgtgcggtgctggtctccaaactccaggtctattttgtagcctattgaggaactgcctctgatctccctaaaataggatgtgctattttggacactgccgtaggtgggagggatgtgtgtttaaagctaaaatagagcgcactttaatttgcgggtgtttcctttttctttctcagccacactgtgtttaagtcacagtgtcctccctcccacccaggagcacagcctcaggcaggccctgctcttggtggaggcctcgtcatgactgatgagggaggtggccaccagagaggaggattcctgtcgcttgggaccaggactgctccaagtccagggagcttttacaaggctctgttcctggatggcttctctgccgatctgaggtccagggtgtgagaagctgagccagccttgcagtccagctgagtgcctctccaccagacctgcgctgctgttagagtcaaggcgaggcagggctgtgggggtaggggtggcagagcacacccctgatccctagttagtggagttaactctgggcactccctcccccgactttctttgcaacaaatcatggtgatctcttttgacctttttgatggttaccaatgtggctgtgaagagggtccctgccccagctggggagaatagggtgaatgggagtaggaaggttgagggggtgagggtagaagggtgtgatggatttccgagaaggttgcaggtatgtgtctgtcctattctgtcctgacttactctgcattcagttctagctgagcatgaatgcagcccgcacccatgactttctgtggtggtgctatttttctgttttttgaaaagaaagaggtccggtttttttgtagattgttaggacttaactggaaataattgtgtaagtcttcaggcatctttcgaagatggcaggctagagatagctactccaacttgaatgcctagcagtcacctagaagacttgttcaatgcagatactgggccctacccacagggagtcagccttcataggtcgggcacttcctcccggctcctgggtggtactgctactgccagttcacagaccacacttccagttgccctagagtgcttgttcctgttccactccccactcaagatattattcgctgatttttatcaccttccccaaactaggctacttattttggtgctaattggtggcacttctaattttagaagtgtggggaggtgctcctgtccccatttggctgcagtggtgctgatggggggtatctgctgtgccttgggtgggaacttctcctgtgtgtgcttcgtgagatatcccgaggctaccctactttgatgagttgagcaaggtgtcttagaagccaggcgctgactgctctatcataattagaagacagttagcaataaatacatagtcagtggcatctctgcatggggatggctggtttgaagcagcttgctccagccatgggaaacagagttttgaccctactatttatgaactgacagtgtgggctgcatcaggatctttccaggtatgccaggaggcacagaacccacgtataacctgcagcccacagtttctgtgacacagaaagtgtggtcaggtrctgggaaatcattgtctcatagataaaacatctgacaygcaccagcttttctgwaacaactaatggttgcaaatggaattcggggtacacaggatagcaacagatttcttcctgtccttgaagaaaactgtctcctttgtccctgtttgaccaacttcgattgagctggagccctttgtgcctggccctgggctgtcccttctgtcagggtctctgtctggtacaggggtcagctctcccttgggctgtgcacttacctaaaactgcctcccagacacctagtttgtgacttcctagaaagcctgagacaggaagctattttcttaaggctttagaaactgcccccaaacagcacagaatggcagggtcctgcccccagggagtgctgcttgaggtctgtttcctgcagtcagggcttccagccagcttgctgtccttgccagcacctcctctgctgcccgctagacacggagcctctggctgacaccctccctgccagccccagaggcctgccttctcagcctctgctgaaactaaagctttttttctgtttctgtagggcattgggtggagccttgccaggggctcctggttctgactgtcttgggtgggtggggaactcagccctgagaggttggctcactgagcatttaccatatgctgggcattgggccagatgtctgtctaggatcagtttattaatccccagctacctgatgaggtaattattattcatttccattttgcagaggagggaagggatgctcagagagaggtggagtgacttaccagatttttatctggtgccctatcatatgctcttacgacacagagcagctttttgctgtagaaaggactgtcgtcattttacctgtgttaggaacatcatcactgactgtggttcccctgcactgacattctgggcattaagggctgagtctgggctctttctcctatgggtgtctgtcctctcacttggccccaggccttggtgaccctctgtgcactgaaggagtaaatgactgaggtggccagctagctcccgtgcatttgcacacatggtccctcactcctggcccccatcccttgccaggcagaatgtgcccgtctccagtcccttgcattgctggcagcctcagaccggagagcactgaatcttccactagcctgtcttcttgccagctgcagccccagggcgcgtgtgtccgtctccgcagccaaactccccctgtgctggcctgtggagggtgagtggggggcagggtgccgcacactctggacccttccagccccaggaaggagttgtggtgctgcacgtgctccattctcacatgcttctcaggctgcaggctgtgcattaccagtgtgcagtttaggaaactgaggcccaaagagagcaaagcagcacctggggactgaccttgagttacacaggtgtgcttcaagttcttctgctagttacctttcaatgccaacactggggagggggtgtcctaacaaaacataatttaatcagagcactgtgaacttttcctgcatctgacacgtccctctcaaggtggagggtgtcaccacctgctgcccattgtaatccctcaccccacagagaggccaggaagtgaacaggagacttggaggaatgtggacctggtgtgatcctgtgtggagcaaggatgtcttcctctgaaaattccctggggggaaagaaatggcatacatttcctataccagtgggggcttggtcccttggcacgcataaatcgaccactcttggcagccagaaccctcgctcctccagttttattctggttgcctgtggctcttggataatcctgtggtctctttggggtgctggtttctttagggagctgcatttggcttaaggctggcatatgttttagctatctgaagtggttttagatataaagattcagtgacagaattctctatataaaatgattatatcacattgagcctcagtaacagattaatggggaaggaaggatttattatgtttccaagtgatccaatgtgagcaagcaggctttgtaccaggggagaattctaagtgcttgtcctccctgtggaattgtgttttgcagaatcccaggaagacagggaggctgtgacagcctgtaaatgtgatgctcagctggccttgagtgtcagctagcttgctggtcttcagggtgctccctgtccacgcaccacctctggctgggctttccgttctctagtgaaaggttttctcagcagcacctttgcctctccttctcccttcattacgagtttgccatgttggagttggattgtttgatgtcttgtcctggcttaacaactcaacactgtgtactttaaaagctccaagtttaggctcacacctgtaatcccagttttttgggaagctgcagtgggaggatcacttgaggcaaggagtttgagaccagtttagttgacagagtaagatcctgtctttaaaataaatataattttttaaacttgaaatttaagcagaagccacgttaaagtggcacagcaggtgatgtgagggaccctgttgggccaccttgctgtaaaatgttttctgtatcctgcttttttcctctttgcctttacacctgtggttcccacattattgggctgagactctggagatctgggtaaaatcccatcctagagggacagcaggttaaatcacttttcctatcttggccagctgtggtttagcttattggcaccagtcagagcagggcctcaagggatgttaggattggttgcacctggttcagaatatggggccctgcaaggagggcagtctgaagaagagtgggattaaaaacgaaagcagccaacagaaaggtgggcacctagaggcaggtgcaactggctgtcctggaaagcagagaggggcagctgtgggcctctgtgcaatggcccctccacttgtcacacctgccagaatggaggtgtctccccagtgggcctgtcacagggaggccagcgaccagccagtcagtgctgacagtaggcaagtgtggttgacatccagggatgagcctctgagcaaccctgggatgtgatgcaaaaagatatatgtgtcctcttgcatttaagagaaatgcaaagcttttgatctaagcttacacttgaaaaaattatacttacattgcttttttgaaaataagtgaaagcataatagaggttgaacatccctgatctgaaaatccaaaatttgaagtacttccaaacctgacacttttttagcactgacatgaccttcagaggaaatgcttattggagcattttggatttcagatttttggattaggtgtgctgaatctgtacgtatataatgcaaatatttcaaaatctwaaaaaaattccaaaccctaaccacttctggtgtcaagtatttcagataagggatactcaacctgtgctaataatgaytttggcatgtactctataataataaaatgtttattaggcagtcctttatgtgaaaaatgataggaataacaatacagtgaatcgcaactcagctttagacattttcatgaccaatacacttgaaactacatatgccttcccaccttctctctaggttaccattaccccaaatttgcttttcattttttccattcatcgaattctttgtgttttgtgacccagtcagtcctactagttttcgtgctaggagacaggaagcaagcattgcttagtttcactcttgtgatgcttgtggtcagaaacaggtatttcttgaaactgggcttgtggctgcagggctgccccaggcggggcagagatggtcaagtgcaaggtggggctgctgtggggccaagtcctgatggatcatgttcccccccggtcttgtctttctaatgtcttgctgcatgtgggatctgtcgccactgccagtgggaagggcaggctagtctgtgtccatctttgttgcagagttggcttccttcaggcaggttcatcctacactgaatgtccctgtggtccatgcctcaaaacacctcatcattagtattacttctgagccctgcctaaacatagcagcgtggaccagctctcagtcctttctcttcctgkccctaccccaccttcctgttggctactctgctcccatggatggttgagagggagaccctcttctgtgtggctagccaaggttgcacattggctgcacccaacagatggactgcatctgtagtcagtctagtgaagtccggtcttcctctccaccctcttgcctgagcctccacctttgcataaagaagctcctgcacccccatccctccttgcagatgcccctgcccacaccccatctcttcacataactgaaagatggctggttctcccagaagagccagaggcctctaaatggagtgaggtcctttctctgcatgtcctgtctctctccagaggtgggcttggaatctctttcgctttgaccggtgactaccatcccctccactcctgtccctcccctgcatcactccatgttacccctggccccagaggtctctgaggtcccatcaccttctgatgactctgtctgcagggatgagtctgttgttactgagccgctagccttcagcttcctctcccrtggtcattcccgaggctgcccactccccctagttgcccacaagccttatgaactcccatctccgttcctcctgtgtggcctgttctggttccctctcctccctgtcaggctcactgtatstttgtttcccatgatcctgcagtcagggaagaccaagccccagttactttcctgatgagctcaaagtccagaatgcagtcacgtgactggggtgggaagccatgcacagggccctgagagggtgtgagggattcgaggcagcctgtggaaggagagcccttccagctgagatgaattcagccccagagaggcactaaacaacctaaggatggtacagttccccagttattaaaattttgcatacttactataaagggtttagtaaaacatagtctagaggaagaaaaccagaaaagcrtgatgtgtccatctcccagtgcttaacatttttatacgtgttcttttcctctctcccactccgcgtgagtgcttctatgtctttatattggtagatcttacttagaatctgactttttcgcttgtcaagttgtcataaaactgatttccatttcaaatgtctatatggtattcacatatgacggagccattatttaccatttccctgacaggcttgtaggctgctatttaatctttcaatttatggtataaaatcctttatagtacaggtaatgctgcagtgagcatccttgtctgagatcccaccgagagtagtggcytcagtcttccaatcagtggcttttctctcacttggctggcctcttgaagcgaacagagtgtgtgtgtgtcctggtagctgagtaaactccagctccgcacatctgcttggcggggcggttgggatctaaatgagtgtgacctcagcttttgtggtagtggagaccatcctgatcatgcagggtccttgctgcttgcaggcccgtggctgctgaagagctgaagaaatgttacttctttgtaagaaacattttagactgaaataaaaacctgttataatcatgcggtctggttgcagcgtgaaatatgttcacagtctaagattcaggtgaaaaggcaggatgccaaatcttgtgtacttgctgatcttatctgtgtagaatatccaagtcagaactgattttagttaaggtatctgtggggggtggggtttccctctctatattttccaagcctgcagtaagagaactatggcaatcatctttctttttaacatatccagcttactgccctaggttggccacagtcagatttcttgaaagcccctagggctgggcgcaggtgtctggttgtccctccgagactcagggctcactctcgcttcgggaacactaatgcaactcttctggtggtgagaacccagctgagagttcctttattttgttgatttcagggtgtaggtatttaaatatttgaaagtattttgatttttaaatgagatgtgtgggaacttttttgattcatcacccttggaatggttacagagttttgtttttataatacaaaactttcttgaggtgaatctgtgactgagaaaatagacatctatttgaaatatcgtgtctaaagtactaaaatattgctggttgctaaccacttaaattgagtatttttcttcataaacattaagttttattgaaagagttgctgtgatttccagacactcttctttactgcttgttcaaataaggggagggggcctccagatgaaaaggttaaactagagtcaggcctgcttgaaagttttgagtcaggaccttcagtgggagatttgccagagtcccacacagtagggcacaggctactgcttccttgggtctctgggaggaggtttctcctctctataatggaaagttggatttctagctttttttctggatacttcatggggtactgtaattgtgttgactaattgatgctctttcctggagtctcactcattaattgggcccatttctatggaaggcacaaatattgtaatgtaagaatcagatatatgctggtgatgctgtgtgaagcagcagagctgctgtgaactctctggggtcccaaaagtctaggaagtttggaaaatcctcytccttgtctaggcctgtgcttccctgtcctctctgtttgctttgcttcctctgtctttctcctttccttgctcttggttatcttctgaaagatgaggcttcacttttccacaccttcctgaccctccctgtccccaaagcagcgatgcatctgaaatggcctaaaaaggcgtggaaacccaggggttcctrttctggcagaagttcctcagttgcccacagggcctgaggtctggggtgaggaacacctggtccagatcaaagagcttttagggtgtggggctggatttttgcatacaggttacatcrggagtccaggagtaaaattaattcttagaaggccagattacataaaaggcaaggcagagagggttctgcaaacactaaccgcctcttgggtgtctgatggtactcctctcatggcctcagcctggagggagctgatgtgggaggaatctgtgggccctgacctggaatgctgcacagtggcctctgccagtgacaggggyrggcaaggctgagtctagaagcaaatgccagcccacaaatgtgcagtgattggcgcctacagaggccagggatagctaagtactgtggagatataaaatgtggcttaccatccttgctcttaaaagaaaaaaggggaaaaaaagcaaagactagttgattcagagctaaggttgcttgttaaataaacttttaaattttagaatagttttagatatacagaaaagttgcaaagagtgcctgaagttctcccatatgatacctcctgccaggctgttgttaacatgttaatcaccatggtacattgtagtgtgttaattgtaaccaaaattgatacattattcaccaaattccatgttttattcacatttccctagtttttaacctaattgtctttttctgttctgggattctatccaggataccatgttatgtgtatttgtcatatctccctaggctccttgtggttgtgagtttctcagaatttccttgtttttgatgaccttgacagtgtttagagacagaatcaatttttattttatcttatttatttattttttttgagacaaggtcttgctatgttgcctacactggtctcaaactcttggactcaagcaattagcctgcctcagcctcccaaagtgctgggatttcaggcgtgagccaccatgcctggcctgtcttatttatttagtcatttatatcaatatggactcaatggtttttttgttgttgttgttatttgggttataattgtcaaagttgagtcaaatatagagacaattctctgttttatttgggaagcaagaattgcagttctgggcatatacacagactggatggtcttccatatgtctgaagaacaaagaaggttggaggttttataaaaagcagaaatgttacccattgttttgagagacagttcattggtactagtaatgtttcgaggagctggcaagctctgattggtgagtgtaaaactattcttagactcacagcagcttgtttcagtagctattagataaaactggtttcaggtcacaataggcagtttcagcagctggacttgcggagaattaccttcctgtggcagtgttacgtgcccagggtgctctgtccctgcttggcttcttgattctgttttagttggatatgacaggaataacccaatccatatgatcaacttttatgtaatccagtactagggtattcattgtgttgctcagattgttccagctttggccactgggggctctttcagttagctcgtgttcctctgacatacctccattattgtgggttgtttgatttttgagtacttccttattggcactgcaagatactccaggctcatcttgtgtatctcctatcccagccctagaatcacccatttctccacagaaccctcatcccttttattggagtgtagtcttagaaatcaagatatgggtgccaagtggctaaagttattgtaatctcaatttatgtgtactcagctgagcaaaagcaaagcatccaaatggcagcggcagcaagaactacctgaggatttctctccatttgccagttctgtgtttccttcttgggctttacccacacagttttctagttgcagacctgttgtgcacctcattcggagttctgtacccgaaattgtctctgtcacggtgatgtctttatgcacaggcactcactctgaagtcactcaccctctcaccagctcatggtggagatgcagtaaaaagatcttgaataaatgayttctgctagttcctctctgagtcctgtagtggctctaggtcaaaagcagtaaaacctaaccagaggaaaaaaccagagyggaaaatattttggacacacgagaagctatgtagacaggaagcaagtgggagctccttggagaggggagttgcttgagactgaagttcagggaaaggaccaggagactgggttggtactggttcctgcgggctggagggggtggagtagggagtgttgtgaaagtttcaagcacagaggactgaatggaagcctcacaatgcaacctaaggactttggattcttgcttttgagtacatgcactgtgtgtgtgtgtgtgtgtgtgtgtgtgtgtgtgtgtgtgtgtgtgtgtaaatggtgtagtttgttggctgtcagccttactaggagkctggtttggagcctgttgccttagctctgtggggtgatgatgggaatagtgaaaaagagggtgacaaaagcagagagtctcaaagaggggacagaactcagtgactgaccagtttggttgatggttggaaagaggtgtcagatacatctgagctcccaagaatggtggtacctggaagggagagaaatcaggaggagccagttctgaagggaatgtggtctcgggtctcagtggataccaggagttcaggggcgggtgactgggtaacttggaaatacaggactgggccttaggagtgtcattagggccaggccaagaggggttttggcatcatctcctgsatggccttagtggataaaactgacaaggctgcagagtggagggatatgccaacacccagccctggcttgaacctgtccctgtcccttgatgttgggaagcagagattccctgtcatgtcagatgactcagaggggccctrggatgctgaggcaycaagtgrgggctgtcatttacacaccgtctgtcgataacattggtaccaagcagtatagggtcttttatcctggagattctgaacctctgtgatggacccctgaggtcccctctactatgacagtcccattctgaggggaatttggccttaatgcttcctctttggcatagcaaactctgcttcctcttcttctggagagggtgcacagaaatgttttctctagtctgtaactatggagaggtaatttgtttctgggagggagacgaagtagggcacctttaactatttgatctgagtttttgtccttgaatcatgtggaattacacatagggtttatatacccccccaccccccaccccatgcagctgcaagattctatctgccttttcttctccttccatatgggattgacatccctgtaggatccaagtgcttgtggagtgaggaggacactttagaagggcctagggtgatggagctaatgcagaactccttgtaacctcttaaggtgtagtggctggcactgaggttggggctgtgaccatggtgagaggtgctccgggtctgggtgtgcctctcagtcttgtagatggcttgggcatgagggagggagggactgacaggaagcaggaagactccatgtgtttggcatggccgcttacttggagaatggcagtgccattgctgagatggagaagaccgggggcagagcaggctggacacagcaacagcgagcatcccagaaaattgggcatcacttgaagggctgggtgtctcatccggtttcctttttctgagcatgctgcatatcacatgggaatctctacaagcagaggaggagaaggtggtttcagaaacagcccttggccctggagaaaggcatcttgtgtgaagacgaaggtgccctgtgggaggagctgtgtccatccctcagcggtctcctccattgggcctcacagaggtacctcaagtccctgcacctgtggtatcatggttatatatggagatggaacccggggtttcaggtgagggagtttgacacttcactggttcatatgtgacatactccagaggtatttgcgacctggtttagtcctgacccctttattgttctmgtggagatactttccttcctctcttcttctgtttgaaactaggactccacatcttgccctagaattgccacccacctgtgtgacgcctgggcctccgagtagatgaggccagaatctccaacagtcacctgcagctggtggggatggagatcctctgcctgcctccggccaaacaacagcttgagtttaatcagtcctttggctgtcataacaagtcatgaggggcttttgtttgttttccaaaattattattttacaacatctggactctttctgctttgaaaacaaaacgaaaaccctttccaaagaaaataaacattttaatgatagcattttaatttaaaaaattacagtagaaaaaaataaaatgaggttacttttttaaatgttgacagagaaaaaaattcaaaacccaaactgggtcagacagacaatagtaggaacaacaagttctgcctatgtcggcttgcagcagagacccagttaatcaaaaacaaattgtatttccaaaaagggggcggaggaggagctttgtgcacttccttaggattttcacatcgtgggtagtaacatagtcagrtggcagatttttctgtttggattaaagtttctattttcagcaaccacttccctgaaagcatgctgctccctgacccgagggtctcatgagcagccatcctggacgcagcgccacgtagggcctggggagcagaaagtcagctgagtgccctgagtccccatttacacccccaggccctcaccattggctcttctttttaaagcatttactcatgctctcgtctggatgatgtggtttccaggcctccaaccaggaagaagccgcacgtttcccttgacaggaaaattgaaagctgattacctggtggcaagtgaggaaggtgagcccatcacagtgaatagtttgaaaactgaaaaggtgcagcaagccaggtgcgtttaataagatctgcagtcctgtgcatcccaagagaaggcactttgtacacagtcacctacctgagtcatgttcattttcgtccccatatcagagatgagcagacaatggagcgcagggaaatgacccttaggggcacacagtcatgggcagggttggatctgtacagcattttaactgtgttgtgattctctagttcagaattgtctttaaaatcagggaaggatatacagatgctcctcgacttaacgatggggctgcatccccacaaactcataagttcaaaatatcatatgtcacaagtgcatttttttttttgagacagaatcttgctctgtcacctgggctagagtacagtggcgcgatctcagctcactgcagcctctgccccctgggctcaagtgattctcatgcctcagcctcttgaatagctgggattataggcatgaaccaccatgcccagctaatttttgtattttcagtagtgatggggtttcaccatattggccaggctgatctcgaacactgacctcacatgatccgcgcgcctcagcctcccaaactgctgggattaccggtgtgagccaccgacaactgcattttttacttctgatgttttggtcttaygataggttttttgggatgtaacaccattgtaagttgagaagcatactgagtgaatttcacaccatcctaaagtcgaaaaatcattgaactcttgtaagttggggactgtctgtagtacatgatagaaaaattttctcctagcatggtttgctttttatgaagtttctacccaagttgtatctcactggccaggagctgctgctagagattttcctactataacatctctcttgtctgaaggggttggctctattgatgtgctacccctgggagggccaatgcattaggcctttactcattcctgtcttactcatagaatcgatcctgctttcagctggctaggaggagatctcaaaggggtgagagagcggggctctagagacctgggagccctttagggatgactggattggtgtgatcatgaaggcaagcacactcaggtcccagggggaggtgaaagcaggagctggctctagaaagggtgcccatggggcctgtacaggaagcataactcttggactgtcttgtatcagttcgatatctgagggactcactgggaaaacagagcctagccaggactcctgtccagagtgatagcagctatggtttgccaagtactgactttggatcttgcaggctattgagaattcccatttaatagataaggagcctggggctggaggggtcctggagtccagttcagttctgcagcacctcctacatgacagagccagcattggagccagtgtctctgttttctcccctgatattatgggcaatggttttatcctggagcttcagcctgaaagaccctccaccagctgcccatcaggtggacgtggttggctggtggcgtcacatttcctccttaatttggattctgagaacagtcttctgtccttgaagattggacaacacttggggacttccaagaacatgttggtgactccctttgcccctatgctgggttccctgagccctgtgttttttggaaagggtgagccctttttttggatgttggttgtgagtgggaactgagccccctacgtgtccagggagctacttcgagggagatgtggcttgtctgcctaccccgacttcctggtgactgatgatcacacacctctcatgatactaagttttcctcttattttcagcttatttactaatcaggatatatgtctgggtgactgttatttttctatttctattttttttttttttttttgagacagggtttccctctgtcatccatgctgcagcctcaacctcccaggctcgagatccactcacttcagcctcccaagtagctgggactacaggtgtgcacctccacgcctggctaatttttgtatttttttgtagagacagggtttcgctatgttgcccaggctggtcttaaacttatgagctcaagcagtctgcctgccttggcttcccaaagtgctgggattacagcctcagccccaaaataatgtctttttaaaagcacggtttaattctatctggggaggcagaactctacatggagtgtagagttcatattcaccaggttaatgccagcttccctaacatgggatattaagcaggaaggaactttgagtataacattttgttgattaagaataaagaaattaagattaaattttattgggattcacttctggaatggtggtgttaggggctgtgtggacttgttgctcagtgaaacaataactgataaaaattattttaagaaaacaaccaaacttggaaatttgccgtatatcctaagggcatacagcacatgaagaaacatttattcaagaaaatctgctagatctcagtaagaatagcagatgtctgtggcacttgagccagaacctgctccttccttctcttttcccatccgctgcccagctcagcatgagagaagctatgaagagtgaccaagaagactgggttccctttcccctaagttcccatcaagggctatggtatctccccaggagggcaggctgtcagcatccccctacctccagcaaggctgcatgttgcagaggctaaattccaggagaatgtggctagcccctactcatagggcagaggttctacctgaggctgagaataatgggtccccagttgccctttgtcagtccagctagtttgtagggcagaggttccatccttggagaatcaagccaagaagagcaaaggctactgctcccatccagcaccctgttcataaagtggaagtgtcactccgasagaagtgggacacagtctgtgcgcccagctctagaacagtgactccaacattttcccaagtaggagaggtaggctataataacagaaagctctgaagctctctgaaagatactgactttgtttataaaagtgtagggaaagttcaagcctaagggtgttctaaaaaaaaaaaaatggagagtttggtggtaattaataagaggccgataagcaataggcaaaagcttgggccagagaccaggaaagagacagtaaagagtgtctgggatcagaacaaacctcaaactctgacatcaaaaactatccctgtgaaaggtctccatttaattagataaaatgtagaacaatgtatgccctaggcagttgtcaaaaacaatagagcaatcaggcagcaattagtggggtctaacagctgggtatgaaaacaccagaggcagacagcttaacaaagagattagggaagatacagacagccctgataaaatgattgtcatcccagagagaatgtgtgttcactcaaggctgtgcccccatgaggagcaaaatcagaggttgggtggggaggggaatatacttcaccacaggagtccagccaagtcattgaaaaaataagcaaacaaaaacaagccctgggatagaggggcttgtagtatccagagttgctacagtgtcttagctaagatgtcattttcaacacaaaattataagatatgcaaagaaataatgacagaaaaatgggtatgacagaaaaaaagcaggcaacagaatcttcctgggagaggacacagatgttgggcttaacaaagactttaaaactgctattatatttgttccactggtctacgtgtctatttttataccaktaccttactggtgcccagaaataaatttatacatttgtagccaacttatttttgacaaaggtgccaagaacaggcaatggggaaaggacagtgttgtcagtgaagagtcaaactctgtaaaatatttgaagagatttattctgagccaaatatgagtgaccagccccaggagatcctgagaacatgtgcccaaggtggtcaggctacaacttagttttatatgttttaaggagacataagatatcaatcagtacatgtaagatgtatattagtttggtcygggacaacttgaaatgatgggacttcagcttataggtggattcagagattttctgattgacggttgaaagtgttaagttattacytgaagacctggaatcatagaagggawtgtttgggttaagataaggggttgtggagaccagggttttatcatgcagatgcagcttccaggtagtaggctttagagctcttatacgacctaaaatcgtgccagactcttagttaattctctcccgggtcaggaaaaagacctggaaagggaaggggattctctacagaatgtagatttttccccacaagagacagctttgcagggctacttcatagtatgtcaaataaatatattttggagtaaaatattttgatttctttcagggcctgctatctgtcatgtgatgctatactggagtcaggctggaatctggtgtcttattactgcagagagtcagttttaagatctctgttttatcagtcttaaggcctctgttttaatgttaatgctggtcaattgtgcctaaatttcaaagggaggagggtataaatgagacatgtccaacctcctcttcccatcatagccttaactagatattcgggtttactttgaaatgctcctctccaagaggaggggtccagttcagttgcttgaggggcttagaattacatttttggcttatagtctccaataaatgctgttgagaaaatgggatatccacgtacagaagaatgaaattagacccttatttcttaccatatacaaaaattaactcaaaatcaattaaatacttaaatatgagaactgacactatgaaactgctgaagaaaacataggtgaggcgcttcaggacattggtacgggcaaggctttttgaataagatctcaaaagcacaggcaacmaaagcaaaaatagaaaaatggcattacattaagctaaaaagcttctgcacagcaaaggaaacaacaaagtgaaaagacaaactgcaggattgaagaaaatatttgcaaactatacrttagacaaggggttaacatcagaaacatacaaggaactcaaacaactcaattgcaggaaacaatccaatttaaaaatgggcaaaagacctgaatagacatttcccaaaagaagacatgcaaatggccaacaggtataggaagaaatgctcaacatcactaatcatcagggaaatgcaaattaaggaaacagctgtaaagtgaggaagaagcttggggcctggagtttataatctggggttggagtgtcctggttctactgctatctgctttatgaccttgagctggttgcttttccctctctgacactgggtttcacatgtggctctgagcactcagtgaaattatcactgggaagtgcttgatggaagctcttttccaccctactcttagcaggtcagatatggggaggaaagagagggagttaggtttctctgcttcactgttgatatggacttggtgccctgtgtcccagccgctctagccgtggctgaaaggggccaaggtagagctcaggctgtggcttcagagggtgcaagcctcaaccttggcagcttccacatggttttgagcctgccagtgtacagaagtcaagaattggggtttgggaaccactgcctagatttcagaggctgtatggaaactcctgggtgtccaggtagaagtttgctgcacaggtggggccctcatgaagaatttctgctagggcagtgcagaagggaaatgtggggtgggagcccccacacagagttcctatggggcaccgcctagtggagctgtgagaagaggaccactgtcctccagagcccagaatagtagctctactgatggctttcactgtacacacctggaaaagccacagacactcaacgctagcccatgaaaggagccaggagggggactataccctgctggccatttgcacatcttcttttgggaaatgtctattcagatcttttgcccatttttaaattggattatttgttttctgcagttgagttgtttgagttccttgtatgtttctgacgttaaccccttgtctaatatgtagtttgcaaatattttcttctgattttgtcttttcactctgttgattgtctgctttgctgtgcagaagcttgggcgcaactgcccaaggctgtggaagcccacctcttgcatcagcatgacctggatatgagacatggagtcaaaggagatcattttggagccttaaggtttgactgcccygttggatttcagacttgcctgggaccggtagcccctttattttggccaatttctcccatttggaatrgctgtgtttacccaatacctgcacccccattgtatctagaaagtaactaacttgcttttgattttacaggctcataggcagaagggacgtgccttgtctcagataagactttggactgtggacttttgagttaatgctgaaatgagttaagactttgggggactgttgggaaggcatgattggttttgaaaatgtgaggacatgagatttgataggggccaggggtggaatgatatggtttggctctgtgttcctacccagatctcatgttgaattgtactcccataattcccatgtgttgttggggggaccctgtgggagataactgaatcatggggggtggattctcccatactgttctcatgatagtaagtctcatgagatctgatggtttgatgaagggaaactcatttcacytggctctcattctctcttgctttctgcgatgtaagatgtgccttttgccttctgctatgattgtgaggcctccccaaccacatggaactgagtccattaaatctctttttgattgtaaattacccagtcctgggtatgtctttatcagcagcatgaaaacgaactattacaactgtgcatcctctgcaagcagaagcaggctcttctggctcttggcctctcactggcaacactcaccaattcaggtgctggatttgggtggtgataagatggaagatgcagatacaatccataaagcactgtgttaaggactgaattgtgtctctccttcagattcatatgttgaagtactaacccccaatgtgaccgtatttggagatggcgtctgtaaasagataattaaggttaaattaggacataaaagtagaaccctaatctcatagaactggtgtccttataagaagagacctcatgaaagagatgacagagaaaaggccatgtgaggacacagctagaaggtgactgtaagccaaagagagtggcctcaccaggaactgaatcagctggcatcttgaccttggacttcccagcctccaggactgtaagaaaataaatatctattgtttaagccccctagtctgtgggattttgttatggcaacctgagcagactaatccacatgtctaatgtggaatctcaatgctctttttgccaattctgccccactgaggaactaggaaagcagtcccactcaaaattataaaagcacaagcatgaatgatgattacaaataaaaaagactgttttggagattgtcttctttctacccttcttcatatatgtttgctgaccagcctggtgacagaagccatctgtcagcctgctgtggagtcgggttgtgagcacggtgatacaggggaacagaatcgcatgtcagcagttatcccagaaatgccaggtttgcttcagattttgatttcctccctgtttcctcccctcaaacagtggtggtggatcatcaaacagtatttttagaactgctttgcagcttccctgtagaaacctttcctcactacatggtttaatcctctcatctagccttgtttaagatctgcagaatgctatatttgtttaactttatttgagatttcaaggcttttctgaatgttgctccaagtaatctgatgaatgcagaactccaaaatttatgccttaaaaggcttaactactgatatgtttggaggcttacttattttctccctttattctaaaccacacagggcagggcagctaaaaaatccccttggaattagtgtcagaaagtccctttttaaaaattaataaacttaaatttttttagagcagttttagttcacagacaaattgartggaaagtacagagagttcctatatgtctcttatcttcacacataaagtcttttaattgggctatcgtaactttcaaggacaaaaggacagtattctcctttatggagaagtagtaagtttcttggctagattgacggccttcagtgatggtaggggagggtgcaagtgtcaggctaactgaccagcctgcagctggagtgaacctgagcccagggtccagcagggtgtacttgtgtccgtgggtctggcggagccatataagatgtcagtggcagactcatatctaattccgggggaaaccttcccagtggtcacaacctcaggccgtgtcattctccagagagaatgtgtcatttaatcctaactcctacctttttaaggtagttttgcccgtgtatctcatttgacccttagtaaggcctagtgtcatttaacttagtaacttgtggtatacagagtcctcacgcatgctttcttacttgagattgcagcgaacttctaaggtgggaatattatccccactttatgacatggggtgtgagctgagagccagaggttccaacagccagcagctggttggtgtctgtttgatgatccgccaccactgtttgaggggggaaaatagggaggaaatcaaaatccagctgtggatggagatggcgtgctgtcctccatgcatcctgctccaggtccattgtctcccaaagggcatgtctgctgttccagagaaaagtcattcagtgatacttgtgaaaacatatgaataaaggaagactttatccaggaccatcacaataggtatggggaccacagcaacgggcttgcagtggtggggggagattgggctcaactcccaatacagcacgggcaagtgggaatttgtagtctaggaacagggtagggggtcagtggatgggaacttactaagaggaaacattgagagtaaagtggattctggctaaacccacctaacaggattcttgctaaactggccaggacaatcagacatcacctagggaatggtggtagaggaacctaatcagatattgaggaggggaggtttttgctaaactggctcagcagggttctttgctaaaactggattttacaaagaagtgcacagatgggcctagaaggttcaggaacctgactctagtttggccaagcagaaaatctttgttactgccactggtggaatggctgcaagccttatatttgaagagttaaatttgttttatatatacttaaatacttagctagtttaaaatattccatatagtaaatttaagttaaaaaatgtgtttaggccaggtgcggtgggtcaggcctataatcccagcaccgggatatttttgggaggccggggcaggcggatcacttgaggtcaggagtttgagaccagcctggccaacatggtgaaaccttgtctctactaaaaatacaaaaattagctgggtgtggtggcatgtgcctgtagtcccagctgctcgggaggctgaggcaggagaatcgctgaggcaggagaattgcttgaacccgggaggtggaggttgcagtgagtcgggattgtgccactgcactccagcctgggcaacagaacaagactttgtctcaaaaaaaaaatgtatttaaagaaaaacctgtggaccacagtacaaggtcatggtagaagcaatgatttcctgagtgtcagtagttcaggaaatactgtagtagtatccatgctagcttcgggaggtgacagtggaagtcaaagtcctgcccctttccagccttgctggttgtacacagaatgttgaggtcaagaacccccccagccccccattctctgaaccttgatgccctcactgaggcagggagtaatgatttccctatggtggggcaggccttgtttttaggagcaaatgacaaaacagaataaacaccattgttaccatttggggcactccaccagcacagaatcatagactgggggagggaggtgagggctggggaaagggaccacatctggcagggggcactgaagtgcctagtttgtgatttccctggaatttgataaattaaaacctggaccaggtcaagagcccaggggctccaactctacatcagttgcgtttccatcacatttatctgcgtctcactagtggttgaagaacatgtctggcccctgcactgctgagctgagcagtgctgtgaagcgttcagcagcattagtgttagtcttggcctgtgcaggtttctctgactgatcctgtgggtatctatgacctcagttatcttcgtacatcagtgcccacctgctcccaggtacactgttctggaatgatgtgaatttgttcacaccttcctagtgggtgtgcatctggccatccaagagtctggtcctcacggaaccctggttatggggccagatgatagtcctgagggcattaggtgatacctgtgttctcctgggctggctgagttctccagatgagagagagcattccttctgccagaggcctgcccacagtggctccactgtcagtgtcctggtttgcatgtacagaggcagggcttgaagttgggtggtaagtgggggcttgaggtggctacatgttggtttacagtttttagtttttctataggtttcttccagtgggagatgggaatacttctaaaaaatgaattccaaagtcacattttccctgatctctttatttcccagctaccaagagtgttttaaaaaatgtaaaagcacacatagagattttaattagctttcactgtcactgctcttggtggtggtaattttacatatgatatgtgacagggagacactttgtgagggcctttgttctcaatgtattctctccctctcataactcagatgtaaaatttggagaaagagataatggtgaaagtacctcaacattgtcttattttcacattgatattcctactcgttagcattttccatggaaacagcaccacaaccagattaggaatctttctggaacaaagggaaaatagttcttgtgacttttgtgagcagtctcactactgcattgtttatgggtgaggtcaccaaggagacctagctcaaaggcaaaagatggccctgctctaagggttttattaatagacctgaaattgcttgccctcttgaattacccaagtggttttagtttcttttgttgtttttgagttattggattttattttatatttgcagaatcagtgcttccttcagagatagggagtttggacggactaggtttagttgtgctgatgacaaatggacctttagaacccctggagacctcctgggacaaacgagttgccctttatgtgttggtcgtgaatgttgcctgttcatgtggtggtgggtgccatcttgacccagctttgccaggtctgagcaggggtctgtctttgctggtgagaagggatgctcattgcaattcttgtgggcaggttcctccctggtttgccccaagtgagaaagagatttgtcttcaaaagcccagtaggagagtccaagagagtaccaggacttttgagattggtttgaacaattgagatcctagggagttcttcactgcctgcaagctaaaacccagctctgtggtctggtgttaaaggatctccagaattgacctcgtcctggctctccagccccattctctgtccttgatacacaagactttcctgtttcctgagtgagtgcttgttgctggatgcacctgtgcctgttccttttgaagtcagatcaactcgcacctcatctggatcatcttttgccagatttcaagcttcttccttgcctctgtagcagcatggggcatgcatctcattttgtcttggagttgtgttatctgaatgttttactccatcattaaactgttggattcttgcaggcagagatcacttctgattcacttgtgtgttcactgtaagtgcctagctcagtacttgttgaacagatgaatggacagttccagattacagactcctttggacactctcatcagaaggcatttcaggtcatcaaaccaggcttgcgtgacaggatgacagagactccttctcctgcaggcagggctcctgtcttctgccctggtcccttccctattagcctgatctttgctgctggttgagaagaggtgccacatgagaagaaggcagatgttgctgttgagcatgaaggtgctgcgtgtcagttggcacttgtscctacatggttgaacttactcaaccacagctctggtgggtagctacagagcactgcccaaggaagggcatgggcctcagaggcacagcttattgcactcttttaaaaactgcatttctttttgaggtttcattattccagccactgtcagctttgcaataaagagctgtggtcagttcactgtggaagaggcccatggaggactgccagtgggggtcctccctcaccaaacacggaacgctgaacaaccagcaacacagccgagtagctgaagccatagaaccctctctccaggaaggtcctatataaacatcaggactgcttgctgcccttttgatttgttttaatgagaatagggaagactgaagtccttttgtgtctctgctaagtgttcaccccaacactgaatgtttcaaacaggattccattttcacagctaaaataaacaggttatacacyactttgccagagatctacatgtagtaaagttgctgaatgtgtgaccactttgtgtttccatgggacctagaggaccaagatgtctctccctgatttcagtttgttgttgaggaagctagaaacagcattgtaacgttggtgctgccacttggaggccttgggcaggtcatccccagtctcctggcttactgcctggtttctaaaatagcattgtcttcccggcatttcattgatctgtgatggttgcttcacatttatagccctttatggaattttgttgctactcagaaaattttttattttctcgtgaagccaattttgacacttgcgaattagaaggcaggctttcctagtgcttagaaaaataaacagagcctgcctgactccacttgtctgaagcacgttattattaactttcaacttattatcasttctgctcttaacgtggcgctgtagaaggaaatgatgtgtgtggtgttaatcttcagtgcctcttcaggcccacgtgccatcctgctgaaggtgcaggactggcaatggcaagggggatctacagctttggctggccttgacattctgcatcatgtgattgagcaagcctgagaccatcttaccagattcactctaggctctctgtcttttctttgttttcccaaagctctgttagcatggacttttgaaagttgcctgaatattaaagtactatactaataacttgctttctagtaaacaaaaccaaaagttggcttaatggttgctcactgacctggcataaactagaacacaaagcttcccatttagaaaaggttcaggcagcctcctgctgggatctgcccaacccctctaggaggtkgcatggatgcccacctcttcttccaagggtgcactttgcctttaggtttggggaaaagtactgggcgagcctttgggactgttgtgtctcatgagtgggctgaccttggtggaggcttgcgtttcccatgtggggcctgactttttatgtgtccagccagagtgatgagctcgttcactttccctgcagtgcttccttgttgaacctgaaagagaggacgtgggagcttttgtaggagagagaggacacatgctttattcttgaactgtgaggtgtatgtcaccagagagaattggagacagcggtgactgtttctcaaaacagcttgcacactcttcccttaccaaattaggattgagtaaaacctgttggtaatagtaaatagaaggaagttacaaataaaacacagtagtcataaaagcagagcagaggagccctgctcacagagccagccgtcaccacagacgcctgggcttgagttgtgtcttgctgattcagcaggagggtgcatttccccttccactttcctgttgaaatatattatttctgtacaatatttatagaatccctgtctccaccattagaaatacagaatattcttgctttttcactttgctattagttgatattgttggctaggttttgtctgtttatcctgttcacaaatttttgttttttaaactttattttttaactatttttgacagaaacaataacaatatttcttcgaggggtttaatttcagcttaatttaagaaaagaaaatcaaacatgaatgatacaaaaaagaatctgctctcatcctaaagttctgccttttgcttctctaggaagccctgtttcctgactagaatttagtgttgcttgatgggaaaagctggagatggagtcagagactgagtaaccacaggagatgcttatgaagacatgggtggggacagggcgggacataatgaggaactctacaactgaaaaagatgatgccttttattagcatttggtagtagtcgaattaatgtgctctgcactctcttctgcatatcggaaagagcactggactagtaaggcctgcctttaggtcctacttctgctgctgctgctgaccttgagggagcccctctaccattgtgagcctggctcccaggcatcaaactagaatagctgtctctcccagcccagcggtgtggtgtgaggaccaggcgagtcaaaacatgtgggcagcatttgcaagctgtgttgttgttgctcacacttatatttcttcccccttgagattttttacctacagagacctctagacaaggtgtttcctcccatggagaccagatgaggcaggtgagcgggcagaaggcaccttggcctgagwagttcttggtctcctcctctcttgaccctcttctgtggattggaaacattgtgagaaactacgtcccttgcttgcattggcagcagacactgttgaagtcctsggagaacacgatgctgtgaacagaccgaggggaggaatggtggctgctcctcacaagaggaaggggtcctgggcacatttggactttgcctcctggagtggcccacaatgcgggcactyccctgtggcagggagggggagtcaaggaaaggaactcagcattttcagggctgcattttcacacagcaagccctaaagctgcgtttgtttcctgaaacaatcttgatttcattcagaggaggaaaacgacattttggagagtctgcggtctggggtgctttgatcctcgttcacagtccagggaggtgtagccacatccccctcctctgccctgcttggcaactcacttttttgtggaatggtggccgctggccactgctgttttgaccaaatagctgggtggaccctgaaggggccattctggccatttctggcctcaggctgggtgacggtagaggatgtagtgtcaaggttatgcgtgactgatcctttctgtaaaacagcccatcccatccctcacattaaaggaatataaacccgagttcatttgtgttggggtttgcttgtgttaatttatagatcactttttttctaattgtttaaatgttctaaacaaaagagtttatgactaattatgtgtttatgttgtgtgtctgatacaatgtaaagccatctagttaacatgagagttatttgaccattctgtttaaagtttaagaaacacgtgctgtagggaaatctccatttggttactgaaagttgtgatggattgaaggggtggtggtgctccactgctttgtgggagctttctcccacccaagctcatgggtagtgttgaagcccccatgctacaacgtgacccccacccccagcctggggggcctggctcaagctggagagaactgggagagcacccatgcaggyggcctctggtggctggagctggagagtttcaagttgggggctgtctcagctcccaccatgtggactggctcatttgcagagtgggaggatgatggacatgggtaagcagaggggaagggccacatttgctgccagccttggagtcaatgggccagctcagccatgttcctgctgaggtgtttagctcagcccagactcctgagacaaatacgcctttctgcctaagctcacccccctgcacagcrtcctggctgctctatatagtgtcttagccaggctagcaggagttcccatgactgtcctyaccatgatggcatcgtcactgcatcccctgggttgagggggtgggtggtgagggcatggggtgaatgcaaaacactgtacggcaaggcaaaggacattgctgtggctgggatgtgggccgcccactttgcattctgtcctgagaagccatgagcagctgcagccacacctctcctgaaagggaagaaggagagaagcagagctygggttagaggctgttctagtggctggggcaagtcagggtccagcttccaggtggccagctctgggcaagggaagcaggagcaggcaccaggccaggcctgacagctttgtgtttgggtggaagaagaaaagggaagagaaatcaccatctttggcaatgaataaggcacacccagcctgctttggggtttagagcctcctgcactcccrcctccaccatagaggagccagactgggttcatgctccacagtcttccagctgcgtctcctggaatgaacctttgagtaacaactctgagtgagtgatgataccccccttattgtggacccacactcagagataagcccaactcacaggtcacggggaagcccgtgtccttatctcttcagttcccggccctcttggagcagcatgtctcctttgatgagggggttgaaatactggatgctttcctcggtcctttcatacacttattcagaaatttatgtgacacgctggaaggacttcctggacaacagacgggcaaactttcagttaattgtgtgagggcttcaagtggtttcaagtgacaatggagtaagaaatgagacttgtcaaagtccttgcctgttgtaggagagagaaccgcgctgctcctggtgcacgctgactgcagtcctaaccacgcagctctgacagcagaccgccatgtacagtgttcctgttgtctttgtctgtggtattgtgaaattgatgtggtaatcaaatgacgaatgaggcctggtgcgygggagtgagaggggtcatgtatgggaacactgggttgattcacctcaagaaaaagccccagaatccctggctgcagaacccaggggtgccgctgcctggaaaggacagagtagcaagccagcccctcacccaagggaaggcttcagaagaggcttggcccccaccattgtgggcctcaggttgtctaccattcatctttgttacactttgtgatgtagctctggaccaagcctcttatcatctttgtatccctaaggcctgctccataatagaccctcaactgtttgttaaagcaggagtccacagtccccgggctgcagaccagtactggcctgtggcctgttaggaactgggctgcacagcaggaggcgagtggcaggcattactgcctgagctccacttcttgtcaatcagcggtggcattagattctcgtaggagcacaaaccctgttgtgaactgcgtatgtgagggatctgggttgcgtgctccttatgagaatctaactaatgcctgatgatctgaggtggaacagtttcgtcgcgaaaccactccccttgaccagccccccaaaattgtcttccacaaaaccagtccctggtgtcaataaggttggggactgctgtgttaaagagattgccagtttacagagaagaaacagcatgaggtgcagaagcaagaaattggaggtgctgaagaaagagtggctgaagtgtgtggtgtggaaggcagtcggcagatccccgcccaccccaggctgctcctggcacctcccagacattgcgcttgtgattattgacacatctcactcatctcccagattgtgagcacctgttttgctcagcacaaacattttaaagcacttttttcagggcaacttattttcaaactgcttcttacagaaaatcccctgaacgttcatggtatatgggtgaaccacaaggagctgagctgcagttgtaaactgggctgtcccaaagaactccaggagaagctgggaaccaagaaggacataaaagaagtgagggaattgcctgccttgttatctgaggaagggcagtcccagagagggtggctgatgcaaaggccacaccagataaaagtctaaacagcaaagaggccagggcaggagcaggatgaagacactgctaggaggttcacaggccccgtcattgcwgttggacacagactgtgaggactgtgggagggacgctggtcaaattcccagggtatgggagttggggtactaagggagttgaagtcgtacttgtggggaagatagagctaatagagttgtcaatggattggatgtgggatgtgagaggaggaggaggccaggatgttatttcttgcctggagcaagtggaaggacagaactccatctactgagatgggaaaccttgaggggctggtgaggtgaaagaggaaggctggaacggtctgggcttgttctgctcctggagcatcctcctctgccctcttgtttacagggatatccatgtccctatccaaggtatctcagtcagttcaggctgctataacaaaataactgagactggtaaacagcagaaatgtacttcttagacctgtggatgttgggaaggcgctggcatttagggtctgctgagggccttcttgccatgtcctcacatgacaaaaggtgaagggcaaaaagggcctacctagttccctccagccctttcatacagcactaatcccacctatgaggccagagccctcagggtctaatcacctcccaaaggccccgcttcttaatactatcacattgatggctacatttcaacataaggaattctgggggacacattcagactgtagcacagtgactgactccctccattggagtctgggatgtgcatttgtattctggttcaggccctgtattatagtagtaagcatatttattaaactaatgaggcatgtcagttaagtaaatgaagttaactcattgccattgctgcctgtccatcatcactggcagacagtagggcttgggaaatggaaagccagagataaatgaacatctcccagtgagcacaagctcgggggccctaagtcaggtcatttgtgtctgcaggtgagaagggatacgcattgccagcatgttacttctcttcctgtgcttgattcaatttttttttttttgagatggagtctcgctttrttgcccaggctggagtgcagtagtgcgatctgggctcactgcaacctccacctcccgggttaaagcrattcttctgcctcagcctcccaagtagctgggactacaggcacgtgccaccacgcccagctaattttttgtatttttagtagaaaggggtttcaccacgttggccaagatggtctcgatctcctgaccttgtgatctgcctgccttggcctcccaaagtgctgggattactgggcccctgtgcttgatttttctaaagcacattactttcctgtatttaagccctagcagcgttggatggatgttttgcagcatgcttgggtgttaagtgtcctttgagtcagagctttactcacagtgaccctctcctgccctgtgcaggtatagagagctgggaggtgggaggtgggagagggctgggccccagctctgaggggaggaggaagcagacctcttcagtacaagaggaccatgatgctgccccctcagaacatggatgtctatcctggagggacagagcacccacctcacttccctgggagtccagggtccactcacactcctctgattgggagactctgaattccttccaacagtagtcgtaacttcatttgacaggcgaggaaactgatgcacagagatgggaccctgtggaaggtcacatgcttcacagcggttcaccaggtctgatgccattgcctgggctcccctcccccatgccaccaagccatattgcttcaaggaacaggcctgtgctctcatgttccttttcaatagcaacctttgggcctaatttttggtgattataaactgtagcgcaagcaaagtaccgtggaccttggtgaaaagttccggttggaggaactggagaaggtaggaaagttgggtaaaactcacatagacttagctgtagagaaagggcttccaggctcacagatggctccagtacaagcgctgtgggggccagcctcaggggaggttaggaaaagccaaggtgagaacctcacatgccaaggtgacaacctcacakggctgacagcccatgtactgagctcyatgcggatgttttctgtgtttcttcacatatgtgcttgctcctcagtgtgtcctggtgagaccagtgttatttccgttatacagaaactgaggctgagagaagctcagcagctctttcacctatgggggaggagggatctgaagtgggattagctgagcaagtgggtggattcctgaggccccactctgggcctcacaggttgatccaagggtttagtctgcggaagggcaggtgttgacacctgtcttaatccattttctgctactccaacaacataccacagcctgggtagtttgtaaagaaaagcaacttatttcttacagtctggaggctgggaagtccwggagcatggtgcccgcatctggtgagggtcttcccatggtggaagagtggaaggtggaagccagcatgagagacrgagaggaaatcgggctaaactcccgatttatcgggaatccactcccctcactcctacagaaacagcattaatccattcatgaggacagagtcctcgygtcctaatcacctcttaagtgccccgcctcccactactgttagaatgacaattaagttttcaacacaggaactttggagaacacgttcaaactgtatcaagagccttttgtggaccagggtgctgggggcctggtgggcttggagccagagccccgagaggcatgaggaaggccttcctgagacccctcccaggtcccctccaccttgtccgtgttyctgcagcatgtggcctttccatcctagttaatacctgggcctttgaggcagcattttttgtttttgtattttatgctagagaagcatatttgactttgtttaaaaggttaagatctttcctaagcagatggcttttgtttgaaagaaaaaaaaatggaaggcctgcttgcttccactattcccttgcaccgtaggatggggaaggacacccagggttggagtagtctccaaagtgggcaaattagaatcaaggaccccaactgctgtatcgtaggcccaactcctcctgcatcgcctcccagaatcagtccttctgcttttatgacccatgccaaccccacaaccccttcccacttgacatcagatggcagttttctccagtgttcaacatcctcttcttcctgggcggccccctcaagttggccatatttaaggaagaatgagttttggtgtgttctcatctcatggtcacacgctcttcttctcatacctgttttatcatttgctttgcattaaaagttgattcatagcacttaactttctcattggttatgtagagacattcattcactcactcactcactcactcacttactcactcattccaaatataaaccagaggaagtttctgctgccattggctattgctctggaatacttggaagcaggccttcctggtctttgctgtatgcagcacgtaccttggctggtgacagacctgagcggatgcttgggagcagaatgtgagctgttgtggcaagcctgcacacaggccagtgctgccttgtctttggagtggagcctccagtttgctggtcaccttgggcttggccattctggagttactgctcctgttctctctgttggccttgccttgtccctgctgcccctccctgtcaccgcagccattctggctctggcccattcagtttatggcatcagtggctgcattttacttaccctgtgcccatccccatgtttgtgccatgtcataraaagtcctcctaggtgcccgttgttctcttatttgctgggcttcaagaattggtggccctgaagcccccaagggtcccaggacccctgttaggtgtagacaaggtctgagtagatccctgggtagattcagtttccatctggccctaggggacccatggaaacggaggctggtctggaacactgtggtagagagtgggtcacattttctttctaggttggattaacagctctagtagagccacttcagtgaacccgtcgtctttacgttaaagtcatctcacaccatggagtctccagagtggtgaggtccaagcctagcctagggaatattgggagtaggggaggctcaggggatgtgttcagggtgttctgagccccacctggagttagagagggggtgtggtattgtgaaatatatacttggtctacctccctcttttcctgaggtattcttagaatctctggagcggtaagagtatctttgtatgctaatgagagaatctctggagcggtaagagtatatctttgtatgctaatgagatgactggtggctgggggctcttaaatttaggatttggctggttgccagggtaaccaatcccatgattagagggctggaatttacagtcttccaccctcccacctctggggaggggagagaggctgaaggttgagctggtaaatcaatggccagtgatttagttaattatgtctataatgaagctttcattaaagacccaaaaggaggccaggtgttatggctcacacctgtaatcccaccactttgggaggtcaaggtgggaggattgcttgaagtcaggagtttgagaccagcctgggcaacatagtgagaccycatctctaattttaaaaaattagtaattatccagatgtggtggcacacacgtgtggtcccagctactcaggaggctgagatgggtggatggcttgagcccaggagtttgaggctacaataagcctgatgtcattgcactccagcctaggagacagaacaagaccctgtctctaaaagctggaaaaaaaaaaaagtacaaaaccccaaaactccaaaggactgagttctgggagcttttggatagctgagcatgcagaggttcccggagagtggcacatagggcgggcagggcagctccacgcccttcccacatgccttgctctgtgcacctcttccagctggaggttcatccgcatcctttgcagtatccttcctgtctgtctgcaggaaggtgatatttgtctttctgaggttattattaatagtaactttcagtgccagtgaatggtgtgacacctcactgatctatgattttagctgtcttggatttggggtttctgagagtaagtcctttcctctttctgcccctctaaagtagcctctttcttagaggctgctgactcatgctcagcttcatgccagcctttcattttactttctctcttgtgctgcctgtgtttggagagcagaggcacagtgaagcttctcagcccatttgctgccacagtgacagcaataggctgtggtggggtaggacgggggtggggtaggacgggatccggtgggtggggcagggagargggcccccattgcacttgggctttttctttgggttgataacgatagttcatatttcatctccatgtgaccttgaaaaaaatcactctgagcatccgtgacctcatccgtgcaactccttttaaaaattattcttagaagaaccccartgaataagcaaaagtggagctctgatgtgttaatcctcacccctcaactccagctccggggagcctgagaggttcctgaggtggagggacctgcagtactcccgctaggcctctggcaaaystttcccaggactgctgctgaaggccttgccacctcactagtcctgtgtgaatcctaacacccctcccgtcctgccagtgccctctccaccacccctttccctgccccccatggctggaagggacatcatgggaagtgggatagaacctcagggtttactgtccacttgatggcctgccgcctcttgtcggaggggtcacatgagtgcgcagagtgaggaatgggagctgctcacttcatgggttattgcttcttttttcttgacyccaagaaaaaattccagccccctagacagctcccacacattctgtctcctcttctgcttaagtgcagtttttcctcctaatgaactctggtcttcaaatggagctgggaggaaaaacaaggaccttgggaatatacgaatccttggtgaattaccttatattaatgagaccaagaagagaaatcgagttcagctgtgcaaattagctttgcgttctgggccttgatgacttaaattgcagattctaattaaatgtccccaaataactatgaagtgcttctaaggtctttttgacctaaaagtttcygtgacctgtgaactctctcaagtgtaaaattagtctgtagatgtacccctttaagcatttctatctccagaaacctcatgatgcctaggatataaaccaccctcctaagggcagagcaggctggtggagtgggcagggaccctgcagggagaggtggaaaggggtaggcatgggtgagtttcggagcttccccagggctggcaggatgttggggtacagatgtgtccctctgttaggtggcctgtctccactgtcataagtgaagggggtgaccgacaccttcactaacaggctgagcagggcagcaaggcaggcaatggaatgctttagacacactgggaaaaggttcaaaagggaagagcctcttcttcaagctgaagtcatgcctggggtgctgccctgcctctggccagcatggggtgcaaatcttcagtgacacaagagtatggctgttagagaaggaggaagacagttccccatgatcacacccccagcatggctgtcatcttgatgcagccrcctgctggctgtcccctctgtacagtacctctttaaatggctgcaaacagagcaaaggtgggctatttctttaaaaacacatgatgcagaactcacgtaagttttttttttaatgctatgttgtcttgtatacactttgtattggggtataaaaatcacctgtgtacagctcagtgaatttcacacagtaaagtctgtgtgtaacccgcacccagatcatttccagagccccggaagccctctcaccctccccagtcagtacccaccccttcaggataccactctccatactctggatgccacagmttcgtttggcctgtgcttgaacttcgtatgaatggatttgcctagaatggtcttaacttttccccttgacgttgtttctgagactcatcccattgtttcatctgttctactgttgacgaacatttaggttgtctcaggtatcttgctactgtgaatgttgctgttctaaaccttctctacaggcttttggtgagcataagtgtgcgtttctgttagcagctccccctctgagttgtatgccaggtcacagggtaggtgcatgttcaacttaagtagagacggccagttttccagcgcgggtgactatttacgctctaccagtagtatcacttccagttactccacgtcctcatcaacacttggtactgttggtcttttgtcatttttgctattccagtgcttgtgcagaggtatctcatgggttcagtttgcatttccctgatgactaatggggttgaagaacttctcctgtgtctgttggctttattatgatcattttgatagccagataatagtgtgtcttatggatgttccagaacattcttttcttacctatagctgggcatttggattgctttattattataagtaatgctgcaataagcatttttacccagtagtcttttccatgttctatactattggcaagagttttgttatcatttacaaattttgataattaatgccagatggctttctgaatgtttgaactactctaagatggagtaacaatataggagagtcctagacagcttcccccaggtcctccagcaatgtgtattctcattgaagaacaaacaaaactcttttggaggacgaatttaggtgaaggaaagcatatttagcattgcgttacttaatgagtttggtcactttttcaaaatgtttaccatgtgtgttcctcatttataaattcctaccttttgccacttgcattttggtgagttttttgttaatgtgtacaaccattactgtaaaaagcagatattagtactgtaagcactttcctgttttaccagtcacattgcacattgcttcacttgtgtgccttttgacgttaaccagcaaatcttccccttggtgatttttattgtggctcccccaccaggccactgccgtgtctgcagagatgcccagactgaaggtccctgggcacccctagtgggagggataggagcatagcctgtgagagaaactgagtcagccctgggctaagcactctgctcttgcggtcatctgattccccgaccctggtgctttgagagggatggctcatgagctgagccctgccctgtggcctgccaaacagcccctgtggtgctgggactgagtggggcctgggggcccagcagcagcagcattgtgggaactcagtggagtttgcagagccctctcctgttcacgcacatttggttttcattgcagccccatgagatgggtgcagcccatccatcctgaagggcagggccttaagagggccctgcagcttctcccagggcctacagtttgtgagtggggaaactggtctcacattctcatccccctaaaccacacccagctgctcacctggctctttaggacaggcccagactcccccagcagatcagccctgcaggggagaggaatatgtgctttctctttctcatttattttgggtttgagcaaaacttgtatttttgagccagaaggttggattggggtgtggagctcaaacaaacatggagtagctcttggcctccacgtttctaggcattgcagtctctcagaaacttcatgtttgaccagcttgttaagttttcgctttcttatttttagatgatggatttggacatgcttctatgaagaaatgccacatggtccgagagcaaacatgtccagtaagttgtttggtgaattaacccaaggacaggagcccaggtccttcaggcacagggtgtggacaccctttgagaagatcagggctgtctctggaaatatgaagacctctgagagagtgttttaaactaggcttattgctcagtctaattatcttaacttgtaaaggttggttctttctagagacagcaggagttgtagcatatagggttggaaaaacctgaaacaccttctcgctgcttaatctagttytgagagcagagtgtgagctctggagctctgagccatgtgaagcgtgtgactcagcctgtggcagtgttttacccagagccctccctttccatagcacagcaccctccacttcgcttaggcccagattacatgctttgcgggaaggaaagcctgagacccagacacacgtgaagtttatgcagctctgggaagaaagccagcaggttagagttgtgagctttgtctcactagtgttttgccacctgtatgtagcccgtggacagcagactcttctgcagctcttacccttctcacagaggttgtggtgaattgatttaaatrtttaaaggttctaagagacttgccaacagaagagcataataaagagaacaagaaaatctcgaaagccatattttataattatatgaaaaccatcattcactgtggcatatctctgctgaagaggacaggacatcctcaagggatcccatggacaccctgtgttggggagtggggaggaagaagtgaccagaaggggcagggagcagyggacagtccaccccggttcctcacatgctggggaaccctgtcactgtacctcgcccccggtaggtcacgttctttctaaatgagagcatgatttctctccatcaccgtccccatggtttcttacaagtgctccttttctcagggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggtgagcctcacagggcctgcaccgggctccaggtatgagctcacagcacctgggctccacactgcagcagtgctggcaggtacccaatgattccccatgactaccctagactacagggtaccctggtttggcatccttctggttgaaccaggaaatagggaagggggatgtcagccctcttcctgtgaaccgcttctgctggagcctgactacattagttttccagtttggtggcaggggcaccaccagggtagtgtgggaatgtccaagtgttttgctggcccatgcccaggccatggtaaaagccctccctgttgtggatrtgtagatctgaggaggagcaggggtttggttgtggggtcagggacttcttagcaatctcaaaaacaaaatatttttaaaataaagaaattgtcttgcatggcagtttttgttgttgttggggggaagtagagggtcatttgtgcatttaatctgaaaacagagaaaagtttattaaggatgatttttctgtcatttcttttctattcaggaaatatacaagacccagatgagcccattttagaatttagcttaggtaggtatctttcattatttttttgttttaaaaaatattttacttaaaaatgaaaacaaaaacactaccaccagtgcatgggcttgtctcagagagcttgctgctgctgccaccactgctgcagcgtttctgagaagacggagccctcacagttgtgaacttctgtggatgggaaggcaccttggagcctccgtgcccacaggctcctgtctcctcagcatggggcccgcccccttgggggtatgctctccacaggtggctggggacagggaggtgagcccacctagagctgccaacagagaccctccccacccccaccccaatgggggaaagggaaggaggggttggggaaaccgggcatagagttcagctttgttgcccctggctgcaaggccttgtgttggctgagtttygctctctagccctcagttccctattgtataaaaggcaacattggcacctgcatgctctctttctcaggatcagataagaatatactaaaaagtggatcagaatgtgctgagtctggggtcagcgatacgtggcatcactgtgcttacccaggaggcctgagacgcctctccatcagagcccaatgctacccagcgctcctctccccttttcccattccttggtcaacattagttggtggcctggcaccaatgtccaagaggtggtgtgacataaaagaggcacctcctggggagtcagatgacctggattccagccctgaccatgccaggctaaccacatggccttgagcctgccactcgaccttgctggaacagtttcctcctgtgctacgtgaggatgctactgcttgtttgagagacaaagaagatcaaggtggttaagcaccccccagccccaaaagacttggacaaattgcaaaacccataaaagtgtaagtacactactggccgggtacagtagctcacacctgtaatcctagcactttgagaggctaagccaggaggattgcttgaggccaggagtttgagatcagcctgggcaacatagcaagaccctgtttctaaaaaagaaaaaaaaaaaacttacctggctgtagtggcacacgcatgtattgccagctactaaggaggctgaggtggaaggagcccttgagcctaggagtttgagactgcagtgagttatgattgggccacagagggataccctgtctctaaaaaataataataaaaaagaaacaaaaaatagaatttggaagaaacagagacattgcagaaagttttaaagaaataataatttatattggccaggcatggtggctcaatcctgtaatcccagcagtttgggaggccaaggtgggcggatcacatgaggtcaggagttcaagaccagcctggccaacatggtgaaaccctgtgtctacaaaaatacaaaaattagccaggcatgatggtgcgtgcctgtaatcccagctactcgggaggctgaagcaggggaatcgcttgaagccaggaggcggaggttgcagtgagccgagattgcaccattacactctagcctgggcaacagagcgagactctgtctcaaaaaaaaaaaaaaaaagaaagaaagaaattataatttgtatactcaagaaaagatagtatatctataaaacaaaaccaggacactataaagataaaaagaacaattgaagaacaagaacaatcttagaagtttaaaatatgatagacaaaatttaaaaaattctatgaagtttggaagttagtcaaggaattcttccagaaagtaagattttaaaaacaaagtagaaartgggtaagaaatagaaatggaaattttgagagtaaatccagaaggtccgatatttagaagaaaaaacagaagagaatgttaagggaggaaatgcaaagaaagaggaaatctccgagaactgaagaatgtgtctgtaggttaaaaatgtctaccaaggcccagcacaatgctgaaagagacccataacaaggtgtattgtggtgaaatttcggatcacagggaataaaatgaagatcctgaaaacttccagaaagaaaaaaaaaaacaggtcatacccaaggatcaggaataaaactggcatggaatgtctcagtgacattggaaacttgaagacagtgagacaacacctttaattatattttcaacccagaattctctgcccaaccagactatcagtcaaatgtgagtgtaggaagaaacttgtttcagctgcacagagttgtacagcaaaaatttacttcccctgcattctttctccggaagctagtggaggatgtgttctcatcctaaagagggaccacactgagcagagaagtcatgggatccaggaaacagggtcatcacaagagagaagtggaaggaatcccacatggttcttaatgagtaatatgtgcttaactttcatcatgacaatgtggatttaacacaaattgagctaaaatgattgcatatggagagagaatgacagttggtataattgagttaaaaatcctcatccgcctataaatcaggacatttctgaatctggtgaacgaaaaacagtaatatagtcatgttaattgggcacatggaggaagaaactgctttaaaaagtaaggattaattttatataaagtgaattttaccccagttttttttgttttgtttttgtttttgtttttttgttttttttttttgagacggagtctctctctgtctcccggggtggagtgcagtggcacaatctcggctcactgcaagctccgcctcctgggttcatgtcattctcctgcctcagcctcccgagtagttgggactacaggcacccaccaccacacccagctaattttttgtatttttagtagagacggggtttcactgtgttagccaggatggtctcgatctcctgacctcgtgatctgcccgcctcggcctcccaaagtgctgggattacaggcgtgagccaccgcgcctggccaccccagttttttaaaaagcgaggagtgggagctggattattgaatggacaaatgtgttgacttttaaaataaaactttaaatttttaaaaaagtatgttcattgtaaaaccttcaatacagaaaatgttgcagagaggtagtcagttatcactttggtatatatccttccaaatatatatgtttgaccctcacagagtactatatggagattttgaatgatttttggttgtggaagtatggaattatttccaaacatgtcatcctagtgctcttgacattcttttttcatgtggcaaaataccttttttaatatatatgggatctgcttgatcattttaaatgccttcatagagtctctaatagagctgtgccatacttattttagccagcctcctactgctggacattcaggttcttcccaatctgccattataaacactatcacagtgaacgtattcatacatagatctttcatacatgttgctgattatttccttaggatacactcttgaatatagcattgttgaatcaaatatatgcagtttacctcaacagcatttatttagtgtttattcagctgggattacagacgatcaggttggagagacaaggcttatatatcagaggtgtgtggtttctatggaaatatgccaaatgaatgacgtaagtgagcctgcaggctgctcagagaaaacttaatggaagctatggaacttgagccaggaatcaaaccctggttgaaatttagataggctgggttgggggaggaggccaggagagattgtcccttgtacgaaggcatgttctgaaggtggccatgggaccatcaacccttaaagtaatctcagtcttcccagcctttggccacctgctgtaccttacgtctgtctgccatcattactgcctgaaagacctgaatattcctaccttgcataggtgtcaagaaaactcacacctgataaaagggcaggtagagagaggccacaggtcattttagggtactttgtaacttaaagaagagacaagtagatcaatcaaattagggaattcctgtccaggcagacataatagaagaaacaaaagagaacttaaaatagtaataaaaccttgaagcctctagaagaaaaataggagaactttcaaactcagggtaggcaaagatttggacagagcacaaaaagcactgtttgttttagtttgctactgctgccataacaaattaccagaaatttagcatgttaaagcaatataaatgtattatcttacagttcccttagattagaaatccagtgtgctcactgggtctttgcttagagtctcacaacaccaaaatcagtgttagcagggctggatttatttagaaggcctctggggcctatttcctatctatttccttgctcattcgcgttgttggcagaattcagttgctagtggttttaaattttaggactccatttttttgctagctatcagttaaggcctgttcccagctcatagaggccactcacattcctcttgtggacttacagtcctcttcctccatcttcaaagctggcagtggcaggtctagtgccttccatgcttggaatctctcctgcctcttcttccattgttatatctttatgattcaccctaaggccttcctcttctatttttaagggctcctgtgatagattgagcccatctgcataatccatctgaagatcacttaatcacatctgtaaagtcccttttgccatgtaatgtaatctattcatagtttctgaggattaggacataggtactttttgtcagagaggggcttctctgcctaccacttcctaaaatttaaaaaagatacattgaatttcatcaaaataagaaattgctgtccataagagacatcactgagaaaatgaatagatgaaccacaaactggaaaaaaatattcacaacacgtatacttcacaaaggacaaataaatagtaaacaaccaaatttttaaaatgagcaaaagacttgagcagacactagacaaaataagttatacaaatgaacaataagcacatgttaaaatgatgcttaacagcataagtcatcatgtaaccgcaaattaaaacacatctattagaatgggtaaaattaacaacaacaacaacaacaaaacaaaacactctacccaactggaacttttgtatattgctggtgggagtggaaaatgatacaaacacattggaaaactgttggcttctcataaagttaaatatattttagttgtatgtaattatgcagaagaaatgaaaaagtgttcacaaaaagacatgaacaacaacatttatgtcacctttatttaatagttcaaaacggaaaacaacccaaatgtctattaacagtagaataaataaattgtacaatggaatatgactcattttttaaaaaagaatgaattatcaatacatgtaacaacacagatgagtctcgaaaacattccatttgtatgaaattcaagaacagacaaaagaatagtgatggaaatcagaaaatgcttgcaaaactaggagatttgtacaagagggaactttctagtctgatgaaaaagttgtgctatcttgttttgatggtgcttacatgggtgtttatgattgttaaagctcattgaacagaaaaacctaagctttttgtattttattgtatccaataaataatgaaggttcatgaagatacatgagaagatattacagagaaccaaaattaatttttggaaataaaaatcagtttattaattttaaaccactagttgtcatttaaaaataagaatgatgagggcatatatggcagagtgaagacttccaaaaatcttcttttctataaaggcaatgagtatactggcaaaaatggtcaaaatcaattggttcagaactctgaaaattaacagaggcttacagcactctgggtagcatttatttaagaaaaatggtgtattagtctgttcttgcagttctataaagaaatacctgaggctgagtaatttataaagaaaagaagtttaattggctcatggttctgcaggctatacaagcatggcaccagcatcttctcagcttctggtgagccctcagggaggttttatttatggcagaaggaaaagcgggagcgagcatcttacatgatgagagaaggattaaacgagagagggaggaggtgccacacacttaaacaaacaggtcttgcgtaaactcagagctagaactcactcatcaccaaggggatggcactaagtcattcatgagggatttgtcccccattatccaaataccttccaccaggccctacctccaatactggggattacctttcagcatgagatttggaggggacaaaacatccaaatcatatcaaatgggttcttagagagctttatgatgttttaacttgccctgttgctatcgtcctctctctagctccaagtagactttaaaggcaacatctttgatgttatagtgaaaatcaatagcctaaaagtccctgaaggggacagaatggggttggagatcctacaaaaaagcccctttcttagagagttatcattatttggcctgtctggcagttccctggaaaaccctacatcctgtacctgcctttatttggcttaactcagaatcagtgacaacagctttttccctgagaatgtttgtcaaaaacaatcactgtccattttttaacattgcagctgccagaggtagtagtaacagttggagcaaacaaaaagctaaccaaaaaaaccttaaaagggaaagctggggaatgagatattcacagggagatttgaaaagctctttcatattcctgggaacttcaaaggccagtgaagggctgtgcacatgtccagagctgtgtgcatactcaggagacgtgaaaaggccctaaacaattacctgagattgaccctgaggttctatgcaagtggcaaatgaaggctaagacagagttataaactgccttcctgaacattgaaaatgcaccccagtatacacacagggactcttagctacagcaaaggtctgtgattctggtatttaaggaaatatctgtccaaccattatctgactactaacctaatgaagcagtcacttcagtggccacacatgacaaagagtattactttacagaattagatcagaaaaggcactgaagaaacagccacacaaaagagcagcaacaacaaagcttggggaagggagagaatctaattccagagatctcacattatattatttaaaatgtgtagttttcaacaagaagttatgagatgttgcaaaaaagaaagtatggctcatacacagatrgaaaaaacccatacagtcagtagaaaccatccctaggaggcacaaatgtttaacttagtagacaaagatttttaaatcagctattttaagtatgttcaaataactgaaggagagtatgtctaaagaactgaggaaagtatgagaacagtgtctcaccaaatagagacttgaagagatagaaactataaagatatctaaatacaaattctggagttcaaaattataataactgaaatgaaaaattcattaagagaggctcaactgtaggtttgagaaggcagaagaaagaatcagcaaacttgaagacaggtcaattgagattatccagtctgaggaacagaaaggaaaaaagaatgaagaaaaatgaacagagcctcagagacctgtgggacacaatcaagtgcaccaatatacatataataggagttccagaagaagagtaaattgagaaggggggagataaaaatgtttgaataaatcatgaccaaaaacatcccatgtttgatggaaaacatgaatctacatatccaggaagcccaatgaactccacataggataaactcaaagagatccacacttgatacatcatactcaaatcattgaaagccaaagacagaatctttaaaatagcaagaaaggagtgacttatcatgtataagggatcatcaataagagtaacagctaatttctcatcagaaaccatggaggtcaggaaggtggtagggtgatgtattcaaactgctgaaagaaaaagacaaccaagaattttctattcggccaggcgcagtggctcacgcttgtaatcccagcactttgggaggccgaggcaggcagatcacaaggtcaggagatcgagaccatcctggctaacacagtgaaacccatctctactaaaaatacaaaaaaaattagctgggcgtggtggcaggcgcctgtagtcccagctactcgggaggctgaggcaggagaattggcgtgaacccgggaggcggagcttgcwgtgagccgagatcgcaccactgcactccagcctgggcaacagagcgagactgtctcaaaaaaaaaaaaaaaaaaatttctattcatcaaaaatatctttcaaaaatgaataagcagtatgtggtgtgtttatacaattgaatgttatcaataaaaaggaacgaagtacagatatttgctagagtatggataaacctttataatgtgctaattgaagaagccagatacaaaaagccacctattgtatgattccacttatatgaaatatatggactagacaaatctatatagatagaaagtagatcagtggtttcttgggggaccagtgaatgggggtaatgggtttggtttgttgtttttggattgatgagaatgttcaggaatttgtggtgatggttgcacaactctgaatgtctttaaaaaaccacagaattgggctgggcgcaatagctcatgcctgtaatcccagcactttggaggccgaggcaggtggatcacgaggtcaggagatccagaccatcctggctaaacggtgaaaccccgtctctactaaaaaaatacaaaaaattagctgggcgtggtggtgggcgcctgtagtcccagctactcgggaggctgaggcaggagaatggcgtgaacccgggaggcagagcttgcagtgagctgagatcgcgccactgcactccagcctgggcaacagagtgagactccatctcaaaataaaaaacaaaaaaagacaaaaaatacagaattgtgtactttaagagggtgaactttatgatatgtgaatcatatcttaaaagaaacgtagtaaaaattaaagcaatgctgctgaaaactcttattaaatctgtgaaggtaaatgaaggaaccatctcacagttcaagtacaaaataacaagaaagagagattgttaatgaagagatatgacagatttggtagttctagtatttgattgataggagacctagaagcagagagagagctggaaagaggagtagcagcaagccagaagcaacagaagaattctttccagagggaagaatggacttaagactcaagaatattccagctgccaggcatctccttatgagactaacaaattctaaggagaaagaaaatctttttctagataaataacaaacatcaaatctaccataaggacaactagaaaaagtgaaaaaaaaaaaaaaatctgaactacctggtccatgctaccagagaactgataggacaataaagaatctgagagcagaggctcacttattcccttgagggcttacagtggttcccaagagaaaggccaagagaaaggattagatggattaracactaagtgtctaaagacacttagtgctttaracagtgtctyagtgagaagtggcagggattgctttctagggtccgttaggggaaggatacttgttgaaacccctctcactttgatctaraatccaaaaggctaaatctaaacctctagagtaaaggaaccagaagcaggtgttcatagggactacaggttcattaagtttctgaaagtaaatgaaaatattttagagtgctagtgctccttggaaccttgcagaagtagttacaaatcttgtctggagaaagcaccatcctagacctcaaataatttctacaagcaattcttaaaatatagtgttcagcataaaatcatgaattctcagaaacatgaggagataagaaatatgaacagaaacaataaacatagaaatagatccaaaggggctgtatatattagagttaagagacagacactaaaataactgttattgactatatgtcttagttaataggggctgctatagcagaatattgtagactgggtgacttaaaaaatagaaatttattgctcacagttctggaacctgagaagtgcaagataaagatgctaggatatctgttgtctgatgggggccagcttcctggtttgcagatggacgtcgtcttgttgtgttctcacatggcagagagcagagcagaggaagcaagctcttgtgtctcttcttttaaaggcactaatcccattcatgaagactctaccctcatgacttaatcacctctgaaaggccccacccctaataccatcacattgggatataagatttcaacacataaattttggggtttgtgtcagaggacagacctacttaaagaaactttagggggacacaaacattcagtcataacactaggtaaagaagaataaggacattattgaacattttcagagaactagaaaccatgaaaagaaccaaatagatattctagaattaaaagaaaaatttcaagaagsaaatttacaaaatgaagccagagcaataaaaataatggaaaaaaaaatcagaggagagtaaaaacagcrtagtgagaggtctaatgttacatttattttgtatctttaagaaggaacacagaaaagggtcagaagcaatatttatagttgagcatttctcccaaagtaatacaacaattcgcagaacaaataaaaacaaatgtacctaggcacatcataataaaactactgaaagccatactcagtgggaaaattataaaagctaccagaaaacacaacacttaaagtagcaacaactagaccgaccgctgacttcataacagaaaaaacagaggcctaggcacaatatatttaaagggcttagagaaaatgactacttagagaacatttccttcaagaagtaaggtggaataaagacattttcaaaccttaaaagctgaaagaatgtcagcaccacacttacagtataaacagtgctaagagatgttcctaagtagaaggctgatgattycagatggacgttcaccaatagagaaagcattgaaaattcaaagacataagatttggggtaaacatctgggttatagctgcatgaatagcaactatagaaaaacacacacacaaatgtgtatgctaacaaaggagagacctgatatggcaatcttaatgtcagaaaaagtgtaattagaacccaaaagagcagatcgagctgtgaacagtggttagttagatcaccacaggtcctttcaaaggatggagatagccagtaacttactctgaatgaacatgacaaagatatcttcccaggtaaactctcctcaaaacatgccaaggtattgctctcccccacccttccaaattcatatctcctccttccctctttgtatttttcagtcttttaatctctccttttttctccctgttctttctttcatttttgttagtgtcttccttcatcccatcactcctcctctctctgaatttcctgtgcatttgtctcacctgttgtggacacaataacatatttttaaattggagttaatacttttttctattttattttaaaattgcgataaaatgtacataaaatttattattttaaccatttttaagtatacagtttggtggcattaagtatagtcgtgtgtcatttaatggtggggctacgttctgtcaaatgtgtcattaggtgatttcatccttgtgtgaacatgatagagtgtactaacaggatcccagatggcacagcttcctaggcacctaggctacatgtatagcctgttattcctaggctaccaacctggacagctactgtactaaatattataggcaattgtaacacaatggtaagtatttgtgtgtctaaacatagaaaaggtaatgtgtttgttctgggacgttaggatggctatgacatccctaggcaataggaatttttcagctccattataatctgtgagaccattgtcatatatgtggtttatcattgactgtaaatgaacaatggctcacttaagaaaaaaaaaagagctttgtttactttgccatagaattctaattttcttccagcatccatccatccacctgccaagacacgtggagcaccatatgctcagagtcagccacagcagtcacaggatgcaagcatgggtagctctgtcttagatttcgtagactctgtggctccttcactcaattggttagagttggaatagttaccgaggtcggacttgaagggttggacctatatgagatttctggctttgtgttccactccatggacatgggaagcccccgtcagcgcagcctttcactgaagttatgacattgctgtcttggagggtggcggggagggggcgtgaaaagagattgtttcaaatttaaaaaatcacttccctgtgacaactgacgatgtgatcgtctcatctctttgaatgtcatttactctttgtgctttctttgaatgtgtttggaacagaaaactaatcagagtctggttttaaaggattsatttctttcccgtgttgattctgtagcttgcagtgagctgcatactccatcgctagatcgaaagccaaatagttttgttgcggtgagtgtcaccacccctcctcaggcattctggacgaagcatgcacagacrgagatcattgaggtgggtgctggtggtctctctctgaggggctgtgggacatgctctagtggtgtctcttgtcctgatgttcagttacttgtgcatctgtagctgaagctgtatttacgtgagttgttgctattttcccatgggttttcagtacattgatatttttcatcacatttactcatctgggtggcatttatattgccatatcctttacagttattgattaactgttggcagcttgtttttgaacartgatcctgtaagcttcattgccttgtaagaggtaagacctaattccttcttgtcacctccaattggctgctactttgcaagagtggtgctcattaatcaaagcttagaagagtattaactatttaccaccctcttgtccagacatacccctatttttgttggtttttgtttttacagccttttgagttttgtgtcacatgttaacttttcccactaagttacatgataaacatttgtggataaacatttatggatgatccttttagatcatcaagcacattacataacactaagtgtaggagttggtggcatgagattctgcagagttttatttgtaaagtgaagaattatcaaacttaaactgcatttcttcttcttcaccagttgtgcattttggaagctagcccaccctttcagtctcttagaaacttatttccaagttcacgtcaacaattctgctttctaagcagttgtcgagtgctacctacacatctagcatagtgccaggcactgtggatgatacagagcccaccagggcacagtccctgccctgaggaattgaccagctggtgggtggggaggcagaaatgaatatggctacccstgtgcacagcagagtatgggaagtattggagtaggaaggtaaggagagcaccaggaggctgggatcctatctggctgtgagagtcagagcaggcttcctagggtggggcttcatgaaattctacttcagtatgtctggggtagggcccaagactgcatttcttacaagctcccaagtgatgcccaggtagccagtcgggggactccacatgaagagcacgccaaagttctgttgtggctatgcaaatgtgtgaccacagggaaggatcatgcaggtttggggtctaactgtatcctggtcagtgtgtgaaaggcacaagtaggagagcaaggaaagaaagccttgaaggccgtggagtttatcagcagatggtagtgagccagtgtaggcttctgtgcaggggagtcacctgaccagatgtcctaacttgtataggacaggcatttgggggagtgagagttggagggagtggaaagaaaggagcgtatgacagagactttgaaggtggaccttgcaaggggagttcatgatcactggatggttgagaacaacagagaagaaggcaccaaagtgaatgcccgggcttttagcctgcttggaaagggagtcagaggtggccttagccaagggcrggtggagggagagatgagttggttgaggccccagcagcccacccaggtggagctgtccagtcagcttgaccacctggatctggatctccagagagaaaaaggagccagaggcccagggaatggtggctgtgataattacctggtgcctgagagagtatggtattacggggctttggaggacatggccaggctgccaggaaatagtcacctatgatcaaaaaactagtagctgatcctaaaaaaaggatagcttttgaaaagtcaggctttaattattccaaacacaggcttctagaaatacataataaaccacttaagccattcattttctctctttcatctgcttatttgtacctcttaaaggaataactcaaagtagtaggtttacatacacattacactttaagttataaaactaagaatgcatgtggacatccaacttgtttcagtttttaaaaattcctcctgttgagtgtgaaacccatgaaatgagtcctcaggcacagcttgtgtaatgggctgatttattgyatgtggatctgtaatggtctatgtcagacttcttttttctcttttaaaaagcagagtttttttgtttgtttgttttatgtatttatttaagccgcctttagcatttgtgttgattcaaggcagtgagaatgttagtttctcattctgaaaatgttggtgtatttcaaaagcaattacattttaaaaatccaaccctgtgttctgattatttccttttctgttctagggaaccaacaatcctatatttctaagcagtattgccttctttcaagactctcttatcaatcagatgacacaagtcaaactctccgtgtatgatgtcaaagatagatctcagggaacagttaagtaatgtgttgtagttcgtgggattttcttccctttgaaaaaattatataatcgtttgaatgagagatgaacacagattgacttcactactggctcacaagttaactcatgtctaaatgcatttgtctttgcgaattgttaagctttcccattgggcttctgacataagggtaagaggtgttgtgggaagcagtcagctggactctctggggccatggtaattgcatcagaagcaaagcaagcgcaccaatgctgcctctcttccttctcttcctcagatgtatttactgggctctggaacgttcattgtcaaagatctgctccaggacaggcatcataggttgcatttaacactaaggttggtattcagttttattcccttgaaaggatctggaatcatgaggtccagggacagatggggaaaggacccacttcttatactgagagagcacccttcccttcccagaagccagtcagcgtggggacactgtgttgtctattgaggcgaaacaaattacttagcctatcagagaatggaaacttttagcatccataggagatatgagcacagctgtaccaagccctaaaggaaggcctagatacatatctagtaatactaagtgtgtttctccattatttagcccctccccagtggaatataatctcccatagagcagggagttttgtctgctttgcttcactgctatttcccagacacctagaatgtgtctggtgctcaataaatatttatggaaggaatgagtgaatgaaagggaaacgcccactgtctcccaggatggaaagatgaaagacatcaggatgtcagtccttccaaatcattttaggggcacttcccaccaaaaccctgacatggtggtcttttttcagaaaaaggtaaaaattggagaactgtgatctgggaaagtaatctagagtagcaaggaaaatttgacaaacaattaagtccctgcagtattgagacattctgaagctactataagtaaagacagtattgcaggcattggctgtctaatcagtggacaggatcagagccctgcagcagcccttagtttgtttagagaacttgattcaggaaaaaggaaccatctttggtaaaatgagagggatcwtgtaagggaaagggctttgagaaaaatatttagttacgtcaygtgtcagagttaactctagttgggttagagttaaatgtacaaaatagacatcattctttttaaaggagctaaaggcggctgatgattgaacagatagagcaggaaaggacttcacaggcacgaggacagggcaaggaaatcacaaaggaaatggtcagtagatgggaccagacaaaaatttagaacctgattaagtgagaccttgtaaatagaaagcctgaagttccagggtgtccccaggttccctggatgaatcagatgagcccaggcyaccatcagccacccttcgggatgtcagggtaaagctgactgaggctggggtagcatcagctgtgtcatatcaggattcaagggcttcaggaagccctggctggattccattacttggagtccaggcttaggccttgggctaatataagcctcaaggtggggtgggaaggaacagaaaagggcccagggccagaacaaggtgttctgtagtcctcactctgacacgtgtccccctcaccctctgggcaggggtgagcacaggcactggcagcagctcaggaacagcattggctcctcctcagggaggccccctctgacttcaccagcacgtccacacttccctgtggtgcgtgtccgttcagacacagccctccactgtgccccatggtttccttgtctgtctcgcctgagaggagccctgtgtgcacagtgaatgctgactgactggtcagtcagctcggccctgctgccccyaggaccctgatgacccagtacggctagggctttgtatttcagcagaaaagaagcacagttgcagcaccactcattaaagcatgttgtgcatcacaggtctgcagagagtgaccgtgtaggtaacatcaccgtgattggctggcagatggaggagaagtcagaccaacggccccctgtgacccggtctgtggacactgtcaatgggagggtgagttacaccactttcctcctctcccttagaaagagcaagggaattaatcagtaaaaatgcagccctcgtggacttagcctctgtgctcagcaaagggcagggcctgctgcttgatgctgctccccacggacactccggtcctccttaggcacaccttgaagcaggaaaaagggctcctgcctgtaaagccctgctgccctggagccggcttctgttctgggtgccacactggccaattctagagggcaggagtgagtgggaaagagccctactggaagaactgcagtcagggggcaacttgggtgtggagggtgagcaaagaggcatttaggacccaggtcatctgtcctgttttaataccttcctctcccagacacatgcatgccctgcagtctcctggtgcacaccttcaccttttcacatcctcccctcttccctggtcctcctccccctctctagctacaccctcctgcacccactgtcatgcatagtctctcacacagacactcaaagaaaaattctaatttcagagccctagcgctggtaagtagtcattgttgtacaatacagagatgtctcatttcacccaaaataagcccagaatgttagttctggaaatatcccttggcatcatctattctcttccttttcgtttttacatcagaacactgacacacaaggtgaagtgactgagaaaccatgcatgcctagagaattgtgtgcgcatgaagtgattcaacacactgggaggtgaatgactttgtggcttgggcagcatatttattgtagagttcatggtggatattcatcttaagacttctgttaygatgtatttaggccactgtttctgctgaatgttctggagtcatctgaatctcacagttttcttgtgcatttccttatacattatcagatggttcttcctgtcgatgagagcttgacggaggcgttaggaatccgatccaaatacgcttcattgcgaaaggacactttgctgaaatcgggtaaacagcttcctcctttggtattcttgcctctctagtgagtatccacttgggcccgcagtcccctttgctccccacctgctgcgattgtcccagccatgcaccctaattgtcacctctctgctgcttatcattgtgttctttttgcagcatataaagagttatcacaaaaaacaattataattttccttgaaagaggattaaaaaataaaaaagaattagtaatactccaaggaagtaatacttcatctcactcttttctgtttcacattggggttggtgactgacgacagcctccctgcccccagctgcttgcactttagagttagttacatgttctgggacaggaagattgcatgttgctgggaagaaatgttcagacctagccacttggtgggttttcggtgtaagcgttttaattcccatgagatgaacagtgagaggacttgaggtgtcaccatccctgagggccgggggaggagaacccatgaggcaggtctgcagccagttcatttgcagcctgtctcccttgtcatcccacctcagtgttcggyggtgccatctgccgcatgtaccggtttccaaccactgatggtaaccatttgcggatcctggagcagatggcagagagcgtgctctccctgcacgtgccccggcagttcgtgaagctcctactagaggaagatgcagccaggtgaggccacatggaaggactgactgtccatcatacccatgtcatgtgccccttcctttctgagatatagcgggcagagcactggcatcagatagactggactgcaaacacagcctctccccctgcagctctgtggccttggcttgcctaagcctcaktttgctcattgggatcatggattcctgtgcaaggatttcataagacagtgtatttgaacccagatgtgtgccccacactcagaacctcctcttttctcttctttactctttttttttgagacagagtcttgctctgtcgctcaggctggagtgcagtggtgcgatctcagctcaatgcagcctcttctcccaggttcaagtaattctcctgcctcagcctctgaagtagctgagattacaggtgtgcgccaccaggcctggctaatttttgtatttttagtagatatggtgtttcaccatgttggtcaggctggtctcgaactactgacctcagatgatccacccacctcggcctcccaaagtgctgggattacaggtgtgagccaccatgcccggccttccttctcttcttttctttcccctctcactggtccttcagaaagttagaaataactggtaattgtttgatcctagctgcccagcagtagttttctaggttagggtcatagataagggctccagaagactgagtataacctgtcagctcactgtggtcccataagggtcttaacccttctgcatctctcaacccagggcatattttgtcagttctaaggtgaggagaagcccaacaggtggcccaggccgtgcatattatgtcccctgtctctctctgttttaattttgtgctgctgtaacagaatgccagagaatgagtaacttctaatgatcagaaaagtatttgactcaaggttctggaaactgggaagtccaaaagcatggtactggcatctggggagggccttcatgctgcaccatcctgtggtggaaggcgtcacacagcaagagcgctcttgagagaaggccaaacttgcttttataacaaacccactgttgtaataaccaacccattcccatgataatgacatcaatccattcatgagggcagagccctcatgacctcgtcatctcttaaaggtcccacttctcaaaactgtggcattcaggatgaagtttctaacatatgaactttgggggatagtctcagattgttatttctcctccttgtcctcaaatggtgttaattataaacacaatataacagaagcgtgaaagaaagcaaggcagccagaatcctgctgttttcaaagagctattttgtttaatttttttacttggaaaaaacatcaaacttaaaaataaagggcaagaggccaggcgcagtggctcacgcctgtaatcccagcactttgggaggctgaggcaggtggatcacgaggtcaggagattgagaccatcctgactaacacggtgaaacctcgtttctactaaaaatacaaaaaattagccgggcgcggtggtgggcgcctgtagtcccagctactcgggaggcagaggcaggagaatggcgtgaacccaggaggcggagcttgcagtgagccgagatcacgccactgcactccagccttggtgacagagcgagactccgtctcaaaaaaaaaaaaaaaatgcaagaagaatgcaatgagcacctagatatctttcacctaaaatcaccaattgttaatattttgccaattgctttctctatatatgcacatattttaatattttaattataaaaattttcattcagctttgcccatatttgtgtatatttacacagtggcaatctacttttccatgtatcttcagtttttatgttttaatttcccattacatggtgtattataactttaaagagtttattcattttttgttagcttgagacagggtattgctctgtcacccaggctggagtgcagtggcaccatcatagctcactacagcctgaaactcctgggctcaagccatcatcctcttacctcagcttcctgaacagatagaactacaagcacacaccactatgcccagctaattttttcatttgttgtagagacagggtcttgctgtgttgcctaggctggtccctagctcctggcctcaagtgatcctcccaccttggcctctcaaaaagctgggattccaggcatgacccaccattcctggccaagagttcattcatttaacaagtgctttagttcaagggttttgttgttgtttttagcaacaaccacatgtcaggcactgttctcagtgtgggaggcttcttggtgagctcaacgtggatgttggttggaaacagaactgggaacctcacgcaggaactccagatgtttcagcgtgtgctggaaatgaaaagggaactgtgagaagaaagagggtgatcggggcaggcctctgtgagatgatgacattaaactaacacctgaagcataggaagccaccacatgaacacgggcagacacattccagagaaactagcagcggcctggcagacagctgctgtgctcagagcggcctgaggccatggggccggctggccacgtagccctacctgctctgggtgtccttttatattaattttgctattttaataataataaaatggcacagcttttaaaaacaatttagacaagtcagatttcctaagaacttatgtaaaatttagctttttttctttctcaaaggaaaacatgagtgcagtataaaaaaaaaattgcagaaaggtttttaactaaaaacaactcggggctctactttctgatctacttcccggaagcaaccaatttttgagagttttagtgtttactgatgtatttccacatatatgtgtaaagtgttctcttcattaatcaatttcagggattagctaccgattttctatgctgagggtttggccttttataccttcccagtccccattttcctaatttggttatgctttttgtttttaaatccatcttgtgattttgctgttatgattgtgtagctgttcttcattgctgagctaaggaatttatatttcagttcttatacaggtttttttttttggagataacaattcctctttttcttctcttctcttcctcctcttcccccttcccccttctgttaccctgtgcctctgtcaagcacacacataaagacaaggtcaggcctgatttcatccacagtgacacagcgggccacttttaggttcagacagctcctctcttttttttttttgagatggagtctctattgcctaggctggagtgcagtggtgcgatcctggctcactgcaagccccgcctcccaggttcacgccattctcctgcctcagccttccaagtagctgggactacaggcgcccaccaccacgcccggctaattttttgtattttttagtagagacggggtttcaccatgttagccaggatggtctcaatctagctcctctcttacatagacacggaaggaagaagaatcagaggtgccagctcccatggtctttgtcccgtacccaaaaaggatggcaatgagacagaagggcttgtgactgcagcaggatctgtggtattccgctgctgaggagccaactctaggctgcagctgagcggttttagattctgcggctcccctatccgggagggcagaaggcccatacctcaggagaacctgggaggcaatgagaagcgctgtcctgatagcctcctaggggagatgacgaggcaagcaggaggtggctcattgcgattactcacagcctgcagtcctctctgttccgggaggatcacacgttgttttgcccagactcaggtgggctgtggtttgagcctgtgcttgagggcacctgcaggtcgtcagggtaaagcttctccctagcagcctgtcttcttctccccacctccacttagtttcccttgaacattagactaaattcccgtgaaaagctactctggacacactgccacgtggtcagtggtctgcttttcatgtagctgtctgtcctctcctccaacccagttgccctttagacaggcagtgtaaccattgtcctggcctgccctgggcatccatgatacttcccctgcaaatgctgttgtcctgggtagacctcctgggcctctctggggaaaccagttagcccacagcctgatgcatctgtgtcttgctttcakagtgtgtgagctggaggagctgggagagctgtccccttgctgggagagcctccggcgccaaattgtcacccagtaccagaccatcatcctcacataccaggagaacctgaccgacctccatcagtacagaggtgggtgcacccccatgctgtcaccacacacgcgtgcgcrcacacacacacacacactctcactctcactcagtcactccctctgctttcccagccagggatctggaacacagggtcacttacacattcccactgacagacactttaatggatttttaaaaataacttcttatgtaggtgtgaattctttcaaatatgggtttttctgatcttaattaaaaagacaaatctgtgaattgcagtgaagagtcctcctatggtgtcatctaccaaaacagccactgtggaatgaaatttaggggaggcgaaatcccgggctattactgcttcatgttgtttcttcatcttggactaatgtcagtataggatgtactaacagaaaggatgtaggccactcgccttgaaacaaagcagtttttcttgatttcccagtttaaagagtcagtggtaacttctattaaacatatgaattgttaaggggtaactctgtattttaaggctcagaaaacaaaatggagtgtgaatgaacacctcactgtttctccttgaaagatgccatttgattttcaaaacactctcagggcagatttggaaatctgttcttgttccttttttattccaagtggaatgaattttttggtttttcattactctatatattgctttagcattttgaattattctctatttttggattcttccctttgattcttttacataatggaatttcagggtttaaggaaaaccataagcccttgatgtggttttgacacagaacatgtgaacccatccataaacttgaatgagaagaagccaaatgcaggactaacaaggaggtgttgcttaggcttgatgtgagtctgaagagagggtctgagtatgtcactaggagaaacggcaacatttgcccaggaaggaaccaagggactcacccatgcctgatgcctcttacctgggaaagtgtggaacccacacaaccttgagttttctagagcagagcttctcaaatgtcactgtgcacccggatcccttgagaattgtgttgaagtggcagtctgggattgtgcctttctcacaggctctcggatgctcatggtgcggtctgtggactgcaccctacgtatcaggccatagagagcagtctcctatggcaaattggagaacacagtagctggtctgtgattcatatgctggcagtatcagtgatatttttcactagatgaaacgtttatttcttctactctctggttgtcagtttaatttgtaatccctttattttgtaggcatgtgattctccatttaattagttatggattctgattatagaaacaagattgtgcatatttgttataaaatagcgtccaggctccttaaccaaccaggcgtaaacagggaaacattgtattttgtgtgtcagaaggccggaatcaatgctatattgcatttgttatcttgatgggcctgcagggatgagaaggcctcttcatcactttcgagagttgagatgtattgctctagccaaaccagattcttagctctttgatgatggcggtctctggagtcagaacaggcagtctctggcgtggacccctttgcttattatagtagtgctgacattgtgctgcacagaatcacattttttgtatcagatctctcagtagagagctgagtcacggaaggcgcagcatcgttaccatagctttttgaagccggttctccctggcaccattcaccacctgagcacccagaaccagctctcctgaccagcaggctgcccttggcatctcacccacctgccacctggaaatgaaatgtgctcatggcaactcagaatcttctaggccactgccgacatacctgcttatatgccacagcatcctctgaattccattttctacttgcaactcgtgaatgcagcatgtatgctgatggcctttatcttctcctattccatttcttagggccctcgtttaaagcaagcagtttgaaagcagataaaaagttagaatttgttcccacaaacttgcacatacaaaggatgagagttcaagacgatggaggatcaggtacctatttttctgctccctcttgttgaatcacatttcgctgcttttctctgtgggtacttggtccctgagtaccccacatctgcccatttccctgtgtgctctgggcrgctcggaggagagatttgtcacaaggaccttcaaaaggtttctgataacagcccacaccccttccttttgtctctcctcactctagcttccctttgtatttctgcagtagaaagttgcctgtcggcccttcttcccaaggagggatgcaaacgggagttacagggtggcttcctgcagcccttgtggctccacttgaaatgttttaaaccccttgttgctgaggtgatggcactgggctccagcagacccttgggcagccagggctgtgggatcaggggaaccaaaggctgtacagcagtgggctggagggtcaggaccccagacttgtgtgcatatccctatagctggcttgtccacaggcctgagcccagagtaatggaggagagctttctgtcattcagatcagaactacgacatcgtcaccattggggcgccagcagcacactgccaaggttttaagtcaggaggtctccgcaaaaagctgcacaaatttgaagagaccaagaaacagtaagtagccagagagggtttgtggtccttgtacagctttctgatgcttcttttctcagtttaaaataaaatcaaaatatgaccgcaaaaacacccagccatcwgatctgcttttgcgtggcaggaggatctgccttatggagcctgtgctgctctgtttatgtgtgactgagctgggtgggtgatgagggcactggatcaatggtcctgtcctgcaaaatgaggagcagattgtgatccacctcagaagtggtgctccaggcaaccgccctatgtagactctgctggcttggcatcctttagagtccctggccagtcagttgagcaccataggcatcgagcctggagcatgttgtttcctagaggacagcagtggtaaacattcccagtttttgaaacattcagggggctgtacagagctactgtcctgagcaggaaatttccaggtagggagggtggtgaagggcatttcagacaaagacatgrcagaagcattgcacatggtgaaatgtggccaggtgcacagtgctgggggcggagagctaagaggactggccttgctgccagcctgctctgtgaccagagttacagcccccagcagatctaggcctggttccaggagctcagggccttgcctgggagtagacaagtcagcaagcaccatttggcatgaacagggcctgaaacaagcatgctgaggatgctggggtgcatggagcagggcatccacccagcccccaggggtgggagggagagagccagaaataaacccaagctgttgtgttagatgtgcaggaggcattgatgatcttccagaacatcacctgtgaagatttcagtggctcaggaagtgggggtgatgagtgtagatgaccagtaagatccttggactgtgaccacaaagtagaggaagtagcatgaggtgtttggtttagggagaataattatgacttagcatgtgtttgggctgataggaaagacagaagtggatgaggtaaggtgaatgagaggaaaacagtgttagagccgggttctcacaggatggaaagaggcaagagcaggtgttcatcagaagggccaggagaagaggtggggctgcagagagatgtttgaggtgggaaggaacaagcagaagcatccgtcgacagcctctgcagcatgtgggctggggagggtcagactcagcaagcaagcatggaacagcgtgagggaaggtgagcaaaggcccagggagcgtcacaagaatcccatggatggtcaggtgaagagctctggcatgtgccatggagctggtggttggcacctgactgtgctgccatggctgggagtcaggacgtgatctgagaaaactgaaagaggtgaaaggtcagatcagtggctgagkgggtcagggaggcagctaggggcgtcactgatcatgggcaaggctgagcagggaacggaagagcgtaccctgtgagaagtcaccattcagatacgtgcacaggctgcctgggtgggcccagagcccggtgagtcccggagggaggagaaacagggaaggggaattcaggcccccagacaacctacttgactttgattcattcccaggggtgcttccctaagacaaaccaggtaaccagacctgtcttaggatttgctgactccaggtccctttgggaaataggaagaagacgcagcttcctgtgccaccgcagctctgcacagccagccagaaagcgtgtctgtcgctccattgcatgttgccctgtggagagtgtgagcgtgcagcttgagatggggtggggccctgaaggagaacccatagtaactctggccagtcaagaagggggccttctgggggtctttgtcccaggaggcttggggtgttgattcctgataactctgcatgttaactttagaatttatttctcaaaatacctcttagtatttttcaaatatataagtttctatttaatttctcactaatgccatcaagccacttatagatatggtattcatgatttgaactttcctttaaatgcggaggtaacttggcctgaggtgggatgtctccctggggcttgagcacagggagtgacgctgctctaaggaataagcacattgggctcatgattgtagtcatccctgtagttgggacctcaacaaataattttaagtattttgacaaaaaataagttggctttttaattttttgtttttgcatttggtatttgctaacaaactgctaatatttcattttggttcttttctttagcagttttgaggagtgttggtgagttttctgtctgtggagagagtgtctgtttgggtctcgtcctcatgcagagaaagcttgtgccatccccacacctcctcctgtgggcttcccctgcggtgctgccatggttcctagttatacacctcataaacagtcctcccttccaactgcaatgttctttaataatgaatagccaatcttcagtctgctgttttacctttaaaacctggcagctgggtgttgtcgtactcactctgagaaaggacctagttctgtttctcccaggaagaggaagggcccgacccaggaagcccctgggtgctgggttctcatgtcagcccctgggtgcagctgggaactcctgtcttcttatacaggagtcttgtggcttttcagttttcacttcactattacctcttatacaaatgaagccagcctacatcttcatgatgcttattaatttatgctgattttaataacactgttaccaaggtcagttttacccctgggggtgggtacaaaccaagatttaatacaactgagtgactttttccaccagataattagatgacagttagaaaccacggtgtctgctgcctgggcttctctactgcttccccaggctcataacagaggctctgcagtggtgcttcattcagaggcacctgcagcccctcaagaaatgctgctgcctcagagcctgtgacccatggggctcaggggctatggctgggccctgctggaggtgtcaggctctgctggtggcatctgacaggaggaagcactgaggacattccccgatgtccaggctgaggcctctcaacttccccctgggggtccttttccctgggggtactttaggtacaagggagggaggagggcatctagggacggttgctgctgctcctgcctccttaatggagcagacccatgctacttctgtggaagtggcctctcagcctcccctccctgccttttctctactggggactctttcaaggcctgatctttcccataacgggacaagtaaagtacttaggggttgagtctagcggggcagaggaagaggaatgggaggggagaggcctttggctttaccaaggagctgcccccaaggcctgctccttggtaaatcccaacccaggtgttttgggttgaaccttgttcctggggaactttctgcgttcctgggttccctctgaggaccctccatagcccaatctgggcctggtcaccccttgccgtctcccccctgctccccatatacaagactgtccctgaagcagggaggggatggagcggggagggttacaggcagaaggagtgtccctgcctggagactgtgaggggctaaatcccaggcagagaggacccagcctcccaatcctcctacccttgcagaacccagctccatgggggctcagcctctgcagaggtgatcctgctcttctaatgtccagagtgactgttgctcagcagttaccagcagttcctggccagggccacaagactccacccttacgctctcatggcatcttcagtttagcccatgaccccagctctgggtaggtccgggtctggggtgggggcctaatgcaaagtccaagggctatacctaggatactgcctcctggggctgcccctaggcttcatgtctacacctccatcctgccgccctcatgtggctgcctggtttttaaaactaggtagttgagcacacatgcttgtattttcctcatcatcctaaacagcacctctttgaaatttgccttttcttgcccctgccatgtatatcccatgcataagtcccaggtatcatcattaaaacatgacttgtgagaatacagggcaagtatagggtagtgcttttctcttggcctgggcagagggtatgtatttgttgaagggtacacagccacctccttacacagaagtagatctacatacagcacattttatatatgtactctaaatattgggggcctgggaagaatcctttttttttttccactgtttttggagtcagggtcttgctctgtcacccaggctggagtgcactggcaccgtcataactcactacagcctcaaactcctgggctcagttgaccctcctgcctcagcctcctaagtagccagaaccacaagcacaagccaccatgcctagctaatttttaaatttttttaaaaggtggggtctcacgatgttgcccaggctgatcttgaactcccaggctcaagcaatccacccaccttggcctaccaaagtgctaggattataggccaccmtgcttggctgaattgattttttaaaatcctattttgagattgtctttttaagatgaaatggtcttagaaggcagctattcatttggaagagtgattgcagattggaaagtagtgtgcacatcatgctgtggaatgactcctgttgtgccccacgagcttgagtgcggtctgctgcatgggcttctggcacatccattgttttttactgtggcgtgtgggcttgtggtggtggtgtttctttccggggtgctttggttttcggtttttgcatgtttgccacataatccagcaagggaaggggtagtggtggtttcttgatgaaccactttgggacttccctgggaaggggccaatggggaagattctcagccctgaccaaggtgactgtcatctccaggggaagtgatggaggatgtggtgagaggtgccctcgctcctcctctctctctcttccccagaattcaaagggtagccctttagggaccagtcaggacccctcatcccatgagcgaagggacacccattctacccagagctcacaatttcaaattttaggaggagacctctgcattggtggcttgtacttcttcctgctttcttcagcttcctcagatggtctgaaaaataaatttataatattggattgattgggatcaggctaagagacatgcaatttatcatcaccgtttagttggacccaacacactggccaggcccccacagcgggaggatgtgaagttggtctttcagagcctcctgattgtgctgggaggggctgggctgtaggcttggcatcagatccctagacacacacgctgcttggtggcgaagaggtgggaaggagggagagccagggttacaaagccactgaggagtccggctttgcctgtggcttggcatgttctccactttttcttcatttgatgaaacgttatttttcaaagtagggaagtcctggagcgaaggaaagggaaaggaaaccccattttctagggacttgctggggtcagacatgagaggaaggacgactgtgggtatgttcacagggagcttgaatgcctgattggccaaaagaaaaaataggttttggttgtttggggacaaagtctaacacccactgcagtctctgctacactgtgataacctgaccccttcttctgtaaatggcctctatgtctccacttaagtactgcttataagttaatagatgaggttgtgaggtggaagattacgatcatttgggtgattaygggatatgattgttcaatacctgttcatacatttacatacacaagtaaaaatacagatacatgcaaatacagataaaagactgagtcatagtttaatatttcaagctcctgccatatagacaggaagaatctcctaagatatactttgctcatcaacaactagagtagcttgagagaacatccctgagtcacagaacacttcatcttagggtcaattgtggctggggttggaatgatgctgtcatccttttcagattctggagaatcccttagaatccattcttatcctttccagtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaaggtaggaggggtgccctgctacatatgggctggggagtttccttgggtttctggaagccaccaggcagcccaggtktacctaagatggtccacaaagagcgtgacattgggatgactttgaaggtctaccttaggtccatttcgcacaaaggcccagggaggttttgtgatttgtccgcagagctggacagaccaagggcagagcccagggctcatgactcttaggtgcagcttcaggcacatgtgcccttcagcaagtccatggggctcattttgttgagggtgatacagttccacttctttctcagtaacagcctaactagcactttttttttttggccacatttctattttagttgaatttgaaaacagaaactgagctattatacagacataagataagaagaatataattttattggcttacatatagtcagtaaaccagcttctacttagccataacttgatcctggttttaaaatatgtaagtattaatccctactgaggaagtggctattatcagacccttttgatggatgatacttttccccattacttggtctctctctcagcgcacacaaacacgctctcatacacacacacacgctctcatacacacacacacaccccagattctgactatacctccacactcacactcactgtgctgttgagctgctgttcctgatcagaatgtgttatatccttcacaggtgttcacacagcatagagtgtgaggtggggattagatcccctggaaaagaaagatgtagttgtcagcagtaacattatgaaccacagaacccgtgttgcatgcagaattctccaaaaccagacatgttgtgccaggaggccagctacccagaacccagaacttgaggtattagatgctgaggaacaaaagataagacttacacaattgaaccaaagtaaggcctgacccctggacacttgttccctggaaggtggaagtctgtcaaggctggggcagtgggctctctctgcaggcccctcccctagcaatcacaggtcagaggtaggcagggatcagagaatgtcagagatttctcaacctcttctcttccttggtgggaaattcttgttaagattcagcccaagtgggccacatggcagtctttgtactcagacatcttgagggatgtagcccttcagttgctttgcactgtggagaaaggcagaggggtgcagtgctgggctttaagcccattctccatttctgagataaggcaggggcctccccagcccctggcctgggctcagcagccttggtttgtgtgcayctgcagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggtgagtctgctgctgtggctgtcatcccactgctgaacttgggctgaaaaccacaaaacctgttgccagtctctgcccctctgaagtgcctcaaggttcaactgctgtgaacaagctccaggtttccttcctggatggctccttggctcctgatgcagggagggaggagactgttttcaaacccttgtgtccagataggggtagggctgtgctgggggctgggccagcctcagacctggatgaagaggaagacaagtgggttttcctcccgtgttggaggtctctccttcccctgcctcctgtgccttctatggccttgggatgcttgagaccagtcagwgctctgtttgctgttagattttccagggctatgtgtatttggggacgtgggagctctggtgctggggcaagtagatatggattttggagctgccgccctgacattacatcacattattgttcctcagagaattggccctgggagcaggatctgtgtttcttgagggagtgacacattgtacaacttgtttttaccatttattgagactactgcttagaggcattgttctacaagcactgaactattaatcagcagcaaagtcccatcctatacactgtgcgtgtttctgcaaatcactcccagaccttcctctcctcctccccacctcccctatcgaaatttctgttcccttctatcaaaaggaggcctccattttgtctgtgtgtgatgattgtaggaagtctgcagtggcaagaggaggagatgagacagtgccctgtggcctttcaggcagcactggagggccacctggcctccagaagagttactagcaaacatctcccaaactctaaaaacaatggccgcaggacatcgattcatcgttgaaaagcaaatgcaactttagtggggaattaggaatcatctttatatttctaaactttgaggtattttaacaagtgtggaagcctagggcaggggatcagtggagggcgatttggtttgtgttatgtttgtgtttctgttcgggagagctgacccacatgggcccctttgatttggaaggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccrctgcatgccatcctcatctgaccacacgtgcgtatgcatccatgcttcccatatgctgcctccatttcaccttgtgctgcttccatttgtctgtgtctctgactccatgccctcctcccccatgcagactgcagggagggctgccaggtggagcgggggcgtcccagtgcatggagcagcaggcagtgagagcggagtctccggttgcctttccatgtaactggagcccatgtgtgattctgcatctctgccagtcagaatctcagggtcctcttgagatacaccaccatggctataagggttgggctcctgggcttttcaggtttgtaaagcaatctgagaacctgaaggaggccaggatgcagatgcctttctgatgtgattgtctatggcattaggaattggtagaatgaaaggggaaaggggaattgttcagggacacagctggatgagagatattggcaggtccagtggacatgtctaaaagctggttggcattggctgggcactctcttatgcagcagaggcatgttgccttgggacttggtaacacagagaatgggaccctgttcctgggcttctggtggtctgagtcaggtggtttggcagracccttcagggtaggacactggcatgaagcagcatgcttcagaacagtctcctgtctgcagagacacagcataccaggacactgtcctgcagatggccttaaagctgggaaacagtccctgcaactgagatgtctccgccttttcctgtaagagccatagagttacaagctaggcagctgagacttgcccacagacctagcttctgcctcctttttgttctcctgtgggagttttaagtcatagtaggtaaggcccagatgtgctgggattaagcttcatgtgatgagggcttttaaattctgaattggagaacttccattcaaggtataagcgtgcctcttggtcagagcctcttggcaaatcccccttcaggttgtaagatgccctttgcctctttactctgcctgcagtctgtttccagggcactgtctcacttgagcctctgtctcgacagttatcacgtcacccatctctccatctatgggggattatggtttcacttccccacacctgtgattggctcatggaactattttgtctctattcatgttctcttttttatgtgaatcgtgttcctttttaaaattttctgaaaattcattgtttatttctttttactttattatcttgtttgtgattttaaatttttctacagataatgaaaagggtaatttattggctgttttaaatgtgggagctagtttatttcatcagatgggattatatccctaacttaagtgtcattttttttctaggcacatcctgtattgtttaaatatagatacatttttattcagttttaaagttagttaagtgagcatttatatatgctatttagggtttgacttgcgtgtgccataaaaatcagctgttgtaataatgggaatgtgaagcttacatttgagagagtctaactctgctgatcagtactcaaatgtatgaaaccatatgccaccaaattatctgtggatggtccttaatttaaacatctttagcacagccaggaagctgttcagtcctcagtgtaagtaggaggatcagaaagaaccagtctgtgagctatttattttggtgagtcttgtccacagtgccacagcatggctctgtcatgactttttataccattccaagttactggagccattgttttggcttaatgagcaggtatgttcacaccaacatatttattatgtgagaataactctgtactgctctgaaaggcatcatcacttttcattccagttctctaccctgtcctaggtccttggtttttatttttcaccagggagctgccctgcctcagagctgccctgccctgatcagagagcactgtctggcaggtgagggtcacccagggccaaggccttgtgggggacccactgacaagtccctgccagccaaaaccacagaggctcctcaaacttcccttcttctcatctctccaaaagtctcccatccccctccacccccgcctgccaaggtgcaccactatcgccccaccaggatttggtggcttccaccgccttcctcctgtacactctgttgctctcctcatacccaaagagatggttagaccaagtttttcttagtctggggtctatgggtacacccaggttcttgtacccctgagattatgtgctggaatttgcatgtgtgtacagaggaagtccagagtggtcacctattctcaactccatgacctaagacaagttacaagccattattccaggagtaccagagaagaccccctttttctcccctttgattgaaagatgaatttagcaaattgggtttaatccctgatgccttcacaggaatggtcccaacctagctgtttgggatcaccacagaagctcataaaacaggctcctagaccttcctcctcattcataagctcagaatcctagaagaggggttatggggaggcaaaaatctgtattttttcaaggcctcacataacctgattagcagatcaatatgtaagagccacagttctatatcactgtgggtttctatctttgttagcaacatggtctcagggcatctggrttaacgaagaggtcgaactcttgaacttgcagatgcctttgtattctctttcccctttgccagtttgaaaagtcacttccaaagacgattagagaggaaggatcctttgccccttctttacaacctaggttgtaaaatccccataaagctggttctggctgttcttggggatccgagaccacctcatttccacatcctgaagacattgtttgaactgaaaagctcagacataaattaacataaatgttttcttccatgattccttttcaaacttgttttctcttagatggtgcacccagttaatgagaaattttggtttttaagggaaatacgaaattgaagtaagtacatcccagtgtgacttagtataggtgaaatggaatcaaaagtggtattctttgaggacctgaagggacattctaattggagactacccctaaatcacaaaacttaacatttgttttaaatttgggagattggcatagagttttttttggtatactggtttcattcctggatcttaacactttggatctcagcagtcgatcctgagcccaggcttccccggtgaatcagagcagtgggactgaccgtggaacacgccgtgtactggtcagtctctctccttacaagtttgcttccagatgccgcaagccaacgcggggctctgccactacaatgtgatttatgtgggtgcttttttctgtggcatttatcacattgtaataagctagatcgcacatcccgaagagcattttatgttgaactattggcaacatgaatgtttaagctggggaatctgtcattgtttaccactgagagggcttggctgccttggagcagccagagtactttcgtgagccttcttggggaagaggcagccaggcacccagacctcttttctgtttgttagccgccttactgcaagctgctgacgcagctgctgctctgagattgagttgcttggtttgaactgtgtgctgctccttaatcatccatgtcgccctccatttctgtgcagattgcagtccccctcctgaagagtccagcccaggtacgtggtttccgttcaaggctcctgctgatgcccttttaattgatactcargtagtgttttgtagctaaattacaaaagattgccttatgatcccagagttgggaaagtattccaggacctccttcgttgtgaggcataaaacacttttcgcaggtttgatgagggaccagttgggctgaggaaattgtggcctgaggcagactaccacatgtatttgttttactcttacattctaaagtctttacagatgagcgtgttgggcttcctgaagtggttgacctgaggtagggaggtacacatctggacttcctgggtgcagttttagaattcttaccagacattgctatgggcctcagttgcagttagtaccagaaatgtaatctctttgcttcctttgcatgtagaaaccaatgtttatggttctagttcaggggttggcaagctacagctctgagctaaatcttgtccacagtctgctcttataaataatgttttgttagaaaccaaccttgcccacttgttcatgtattgtctgcagctgcttttgtgcagcagtgccagagttcgttgcagcagagaacccgtggccttcaaagcctaaaatatttactgtctagctctttacagaaaatgtgtgctgacccctgatctagttcatattgagtttcctgggtatggcttgtggttttgagcatgagtcccccaaataatatgatttgatgttctttttcttacattccaaaaatcagctgcatggtcagtctattgcttgcatatttctgactggttataaatgtaagacagcaggatactttgttgatgtctagaatgtagcgagtccatgactgtgggatttaccaggctaacaagctattcctgtgcattgctagtgaagcctgtccacccatacagccccatgagtcagcatagtgtggcagctcctggcagcaaccccaggacgctcttagaagttagctcattggcgggctaatctgattggacacctcatactctcccagtttgctttcagccccttcacagtttctctttccccaaaagtcagtgtcgctttgagcaggctttgggccccacccccttggaccctcaaggttactgaggccttggtagatgtacaaacagttgatcttggtctcctcctccgttgcctccccgggcccatgcctcagctgacctccacggcaggccagtgccttcggactgagctggctgtcgcctgagcctcagtggtgcccaagcctggggccatacccagcagttagggccaagagagggctggtggcatgtgcatctgcccccacagaagctcagggggtcttctcagttctgggctcctgagggttgcagaactaatgggaagtctcatgggtccccgggcagcacacagacaatgcctggcctgtagagccctccttgttgtgtgtcagctgggacatttccagaagcactgatggctttttcacagttgatgctgatggactaaaatggtccttgcaaggagttcttttggcttttcctggagaactgcatttaatctgggctaaaatatacacacttacaaaggcacacacactctccctttctccctcccctactgatgaggggaaaatgcagaagcaaagtacggatttgaaagtgctcttcaaagttatctaaattagtatggcccatgaattcactaccggtctgcgaacattacgggttaggaactagataaggagttttctacaaaaacgtgggtcagcgacgtcactcaggacattgtttcactgagctgattttttctcataacaaggctttgtcagtgaaggaggcagagtataaacccttcaccgattccagtgacccaggtgcctttacttcactagatcctgcgtggaaatcatgttactgcccaagaaactcactttggttgaacttttaaaaaattgttccaggcatgtctgagtccttctctgggcagataacgacactcaccttctaccaagttccatatctcctcttttccaggacaaacatcttagtgctttttagccattcttcctatactacaattttttttcatttttttcctaatgtagcgaagcaatcgttctcataggaatttagtttaaagagatataggcaaagtgaaaaagttgtatggagagagcttgtttagtcaagtaagaccagttgtatattttgatcattttcagattaaaataatcatgattttcatgatatgcatgacagctagaagagcaaagtaaaattggcaacatttgctttaagagcatgtacttcttagagaaggatagtcttaaagactgcctgcctttccccaaaccgtttggcgagaaaaacttgtttgcctttggcatttttaataggcacttcatataattggcatacattcaacagaattcttcaaagaaacaaaaacatggtctctgagaactttagtggaggaaagagactcggacattatctagtgcctctctctcattttataaaaaaggacccacatggctgaggggtcgagggccttgcctgtggtcacctctgctcagcagtggccggggccgggcctccacattttccacctctcagttcagtgtccttcgtcaccatgattcatttgctaagacctgtctgctgtggacttgctaaatttaagcctgctttttccattacagatacaaatcctgtccacaaacagttagcgtgcctgcatgtacaattaggccacctccaamttttgagctgctacatatacttaaacatttgcattaaccaaacactgagtgtagggaattcttttatatgtttcagtatttctttaggttggtttctcagtgaagtgctaaccatccagcttgagagaacagggccaagccgcccttctctcggtctctgagattctgtttatctaagacagagtttatcctctggcagccgcacagctcccacagcccatggccttccctgagtgccgtgccgggacatggcctggcgcattctgtggctcgaaccctcaccctaaggggcatgtactgcctgggcttcactccatgacttctcaccatgtttggtgtggtggattcaccaagtggtgatggtcacatgcctatttctggtcttaatcacctgttacaaatataaccttaatgagagcctgtcttctcttttaaatgtcttctaaataggaaggaaaaaaagagtcaaaacccaaaatatctttcaccctgtttttctcccttgaggttctatttttaaaaagttgttttggtatagggtcaaagtttccctatattcctaaaagaaaactaagctagaaatagtactggggaaggaaggtgggggtggggaaggaagtgagtgcaaggtggggccgttctgagggctgaaaacttgggagctgtrgggaatagtcctcctccaggtgtgcaggggtaagaattgaacacagttgcacacaaggcttggcaagggcagaggagtctctgacttgactttatacccaggtcaagagaagggagatcacagagaacctttctgggtgtccttcctctccgggtggaggtgctacagggctgtggaaggagatgggcctctggggacagagcattttctggcctcgtcatgacttgcagaagcttctttgttgttttcctccgaaggcattgtcttgagtatttctgtttagggtccccaacaggttcaggagaccaggcatgtcttggaggtaccggagtagaactggtgtttgaggttgctggaaagagctggggctagagggctagagggctagagactgggttggttccagacagagctggaagatgaggtggagatgggggagtgggaggactgcagtggttaggggccaggtgacttgttaaattgccagaacctaattcttaaaatctctctctcattgtgatgaccccttcgcttgtgccccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacggtaggccccgggagcaccccgagggagaccacgggcacctctcagctcagaaaagacaggcttaggaagcccttccctctcacttcacttgtaaaagaccccagatggccatatttcctcctggtggtgctttaaaggttatttaatagagaggtctacatttcaacacagtcaggagaactaccttggcagcccatgcttgcttctcccaaggaactggcacctgcagagtctgccgattctgcacccaggagatagtgagggcatgcatgggtggcacaggcttctttgctgcgtttttttttttttttttttttactgcacagaggttgagtgagggcaacacaggtatttgctgtcagtgcaaacattgctcgtataacagtaggtgccttagctctgcagcttgttgcaggactctcttattgttgagagaagtgaagccttgaaatgaatgtaacaagtttaatagttgccagtaatcaaattagtaaagtgaacagtgatttggggttgggctggttctctacaggttccctcacccatcctggagagtcctgtttcatcccatagaaaatctcccactggggaaactttgagtgaccatgttgtctctcacttctgttttttgctggggctaactcagtttccagccaggggtggcatggctctatgagtagatagaccctttcactgtgagtaattaataatgggcttccagaagttccagcctaggaataaagccaggtataggtcaggtcagaagctgggccaaaaaccaaacccacttggtgagcgacaggaatagcaagcccactgttgggcgtcttcccatggccagggcatgccccacctgggcttctcaagggatgggaggtgccactgaagcccctttgagcagtggcagcagaggaagggggcggtggggggctgggcatgatctgactgccatttggtgagcaggcacctgaccctgwacctcttcaccccacgctcccacagctgaccgccctcatctgcggcttcatcattaagctgaggaactgcctgcatgacgacggcttcctgcgccagctctacaccatcgggctgctggcccagttcgagagcctgctgagcacctacggtgaggcgcccgggccaggatcgggagccccacttgcgtgtgtggtttccatcctttcttgctaggcacttttctcactataccagtaatgcgtgcttattgaaataaatccaaaatatataacagcagaccagatggcagacctggcagttacacacgcacacgccttggtttgttgttgttgctggttgaggatggatgctaattacttaaccagtaacttcctgttggactttgggttgttcctgaaacaccagtgcagcagtgacatctgtgcatgaggcacttgtgggcctgtttctgcagctactgaatgactggaaggagagttgctgggtcagagggtaggaatatttttaaatttaatagatatttccaaattgccctctaaaaaggctctcttcttcctacccttgtttattatttatttattctgagaaggtgatagaaagcatttgttaatcattggaaattgaggacatcgaatagatatcaagccctgtgtaatgggagggtctggccacagcaaagctgctttagcatctctcatttcgtgtttcaagagctggctttgctttctgagtttatgtatttgtttccctccctactatctggtgcttgcccaagaaatagtgggaagggatggcgcgtgtttccaccagatgcatgttttgatgtggctgtgggatttcagaggcattgttgactcacagaggagtgagttgcaggggaagaggctcagagactccccctccaccagagccacacctgcacccctcctgtcacagccaggcctgggcttggctgccttctgctgagactggggagagtagcagggccctctgcctgacagccctgcccctctctcatgtccaggggaggagctggcaatgctggaggacatgagccttgggatcatggacttgaggaacgtgaccttcaaagtcactcaggccacttccagcgcctccgcagacatgctgcccgtcatcacaggaaatcggtagagtgttggtttaaaattctctgagccagagagcggttttcatttttgtttatctcagggaaggtactcttctgaattttttatcctatttcattttgttaaatgctctgattacagccccctaggttagtgccactcccttaaaggtctgtggttggcagtttggccatcactaagccagagggccagcctgggcactgcagcctgctcggtggccctctggcctcacactgctctccctctctccacctttctccagcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtgcgtgccggctcctcggggctgcgggggtgtggtggccctggagatgatgcagaaaacgtacttacccctcttcaggctctaagtgctggacagactttgtcatccttccttcctttggccaacattttcatcatggccgtgcacctcactgtctttggtgctagggacacagagtgacccagaggtggtctctgtcctcagggactcagctggtgggagagagagagacatggatgcaatgatgaagacagatacagggcattgtgggatccggagtagggcacccagcaaggtctagggggtctgtaaaggcttcttggagttgcaggggatggggctttgaattgtgaataggagttggatgatgaggtggaggggagacatgtcagattaagaagactgaagaaaggcctggcgaggagaaacagcatggagttcaggggcaccaggttccaggcagggattggcaggtaagggtagacaggctctgtgtgccaggctgagactcatgcctgaacctaaaggcaactgccctccagggtcacttgccacactgcagaggggagttgtgtgtgcctgtgtgtgcacgtgtgcctgtgtgcgcacatgtgtgtgaggagatagggtagattgggtatatgtaccctttactggccttccactagtacatgagaatgattcctgtgttgtcatttatcttcatgtgatatgtgtagaatagtctaaacagagatcttcaagtacttgctgtgaaggaaatttggtttccagaacaatatgccgtgttcctgctgggccttctgatgtccaaccccagtggttgatgtccattgacgcctaggtgtagggtcacaccaacttaggaaatatggtatcattgctgggagacactgaagaactctcagtggggcaggacacaatcagatttacatttaaagtaggtcgtttcgctggcacgtgccgggaggagatgaaggggacaagtgtgaggaggaggctgctgggaggagtccaggccagaggtgggaacctggatcagggccaggggagtgttggtgttctgcagaggggtaggctggggaactgttaaagtggtcagtggaagggtttggtcttcagtggggttggggctggggctgagtgggaggagagtacaccagacagacccacccactgagctcataaactggcaggagagtcgtgtccagaggcaggtggtgagctgggtttggactgagggcaccagcccaggaagcaaagccccaaaggtgtgagcagagctggaggcgcctatgtcagggagaggcgcagcctcactggagccccagcagggaggtggcccaggggagggaaaatgatggtgcctgcatccagtagctgcggrtcccacagacttgcaggagcagtttctagagagggctgagccagagccaggtgcattgaatagaggggagggtggaggatgcaacactgaggacagagaggacttgcaaagggcaggttcttgactttgtttctttattggccctgaggtcactggtgagctgggcttgtttataagctgagggaagagccctcagaggggaggccacaggcccagagtcagggatggcccccaagggagcaggcgtctagagaaaaggccattgtggacaccaggggtggatgggctgggacccgtaggagggaatcctgccctctgagggatgctctcgggccacagagaagctgatgctcggaaggcccctcagcagggatgtgtgagactgcactggggcccaggacctggacttcagagcctgcatttcctaatgatcaccttgtgccttccttgcaggtggcattttatggctttgtttcttaggcatttggcacatgctccttgtagcacactgagtgtgatcagggtgaacctgcacgatgacgaaagggcaagggcttcatgtcagtcccggaggggctggcagtcaggtgtgttcattctgcacacagagagtgacttcagattggagtacagggctgcatcctcacctctcagccatacctcactgccgtcccccctcctaagtgcctcagatgggaggagaccagggactctgagccaaatggctgtgaggggggatcctgtgctgcacaggatctgtaccacatcatgttctggtcatctytcaggcacgcctgtaacagtgatacatgattcctgccaatggaatgcatttaaactgatcagcaacactgtagaaatgcctttatgctcggaagagggagagtggcttagaatttagatatgcatagtaaatgtttgagagaatcagcatagttagcttccatgcagttgtgttcatgttagaagaaagtgacattagccaactaatggcatcccctataacctcccaaggtttggcgatacgtctttacaagaagtcatcaacgtggagagtttggtgcggttaaattcctactttgagcagtttaaggaagttttgcctgaggattgtaagtatttcttcagtcatggtaggtttcacttactcgtctttttatcagtttagatgtctgagctctggcttgccctgcctctgtgagtgcatgcctgtgcatgtgtgtgcactgttccctttctccctaaacacacacacgcagagagagagagagaagcttcccttggctgtggccctcattcatctctttgctgtcgattctctactagcctatgtgacatggctccttcccatgctgtcgtagtcactgacacaagatgtgtttggtggcatgcattgtgcacctsctggtaggacttgggggaatcacagaggcaggacccaccctcggccaggtgagcggcccactcacttccctttgtggtgcttagagaggaagatgcggggccaacattgctgggtgtttgggagcaaggtggccccatctcggcatctcctggaggcagtggagatggtgacagtaatctctctgcgtgtcctgcagtgaagatgctgcagctagggctctgcagccacagaactaagggaggaaccgagagctgcacagcactgtctacgagaattccctcttgagttcaacccagtgaatattccctgaggacctgctgtgtgtaaagtgctagaggatccgatggcgaatgaggggtggaccctaccttggagggaaagctggtcccagagtgccggcctctctgtgcaggcgctgccacagccactagggggcgccacgygtcagaaggtatcatcccctctgtgttacactagtgtcctctgatgggggtttccaaagagggaacccacatcggctgggctttgcattgggcaggcttcatctgcatcctgttggacggtacggtagaccttagagtttagagatagtcaaacagtactgctggtgaaccttcacaggtcacggatgtgccagacactgggctgggctctacatacgtttccacgctgaatccacaacagccctatgggtcggtgataggatccatgtccagatgaagaaaggggtgcctggctctgaagcccatgtgcttggattgtggctgaagccgtcctgctaggagagagtgatgcagaacactccggggctgggccaagaagtcgtggcttcagcagggaagcagtgggaaaaaagacgcctcttcacaggttcatctagcaagagtgtgcggttggattggaagaggggaggcaagccgctgatggccagagtgaggctgtgacacttcagatgagatgttgtttcactctgactccagcctggtwgtgacagtgagcgtggagagagggatgaggcgttaggggggtttgggctgaggatgcactcctcagcggccacgtgcagctggcgctggggaggtgagggctgtgtctgctgggagagctgacagacctggctctgggcaaggacgctggagttgccggcaacagctggggccgtcccgctgatgagagaggcgcagggctacaggggaccgacagcgagtgcagcactggccccagctgagctgatgacatgggcaaatgacttgtggggagtgcagatgtggagccacagagcagagccctttggtggttgaggccactgagtgacaagacgagaaggggctggaacagcatctggaggggcccctgctctgggggacagcgaggaagaagggactcaacagaaggcgagagagagcatcacaggctagcaggaagaaggcaggagccaggagggtgtggggcgctgccggacactggatgtgtggacaaggagctgctggtgatctctcccatacagtctcactgtggtgagggctgggccagggatcaaggggtgatgaaatggtgctgccctggaatggaccactttgtcccaaagactgtcagcaacttgagggatggggctgtgggcaggtgggacacaccctggagctgcaggggccatgggagtgctcaaaggtccgagggaaggagaacacacagggctggaagatgcaagaggacaccagagtcacagaccaggccctggagtgggcaggcggagggtgcccttgcagggagggaaggagggaggagagaaggtagggacatgaatggaggaaatatgctcaggttgggcagcctcagtctccccagtaaaacaggtgttcttgtcctgctcaacatgagagaggtgagcacagaaccggggccttgaggggagtggaggtgactggcagagatgcagttggagccagagagcctggaaaaatacagatgcctgggccccaccccagagtgtggtgggcaggacctgggcwttagggtttcagaaactccccaggtggtccctgtgtgccacagccagggtggtaaacatagcatgaagtcaaggtcctgcgaggacttggcagctgaaggccatcagtgccatggacgtcagaactgttaagaaggtgtcctcatgctctttagcagggaccggagttcaaacagcagatttgtcacatgctcgccacaagctgggccccctactayccactttatgtggattctctaatctgatccccacagcagccctgggaaatgggcaccggtttcacacccacttggcaggtgaggaaactgaggcatggagggcaagtctccccaggagctgggccaagcccaggcagcatcttctgactgctgtaggggagaggatgggcccaccggcagggccagccaaggagccacgaaggtgagcagggagggagtagggggcgcgtgctgaggcctggaggagtgggagtggtgagcggctgcagtaagtaggaagggggaatttgtgcctagcaccttagagggcaggcagtctccagggctcggggagctgttacaatgggcagtgaaggcccaggatgggcgaggcctccggaagcagagcagccaggctggaccacgcaggcaggaactagtcgactggaccatgacccaggaagctggggcagatgtgagccaggtacccctcccctcagcaggatggctggtctctgaggctgaggagatggagcccaccagctgaatacccccaaactttgtgtggttcctcagtggacaggtattcattaaagcaggggctgcaggggcaaccagcgagaagccaaagtgcatcttgggaggtgagatggtgctgtctatgccagagggcaaatatcctgacctggctaagctcccctcctctgggctcccacagcttccgtctcagctgatgccacctttccatctttctgtctctgccctgtcccctgaccggcgtggtgtggagcactcagcagcaacgtgaagtaattagcacaggacctgtgtacgccagggcgaggctgtgtggtggaaaccaggtgtgcagttagatcccaagtgctgccatgtacttggtttggcttcggggattccggcgctgtggctgttttccttagccatgaccttgaggctcttctctttgtctctgataatcccagtgtttgaaaatcccagagtacctttccaggagtggttgatttttcctcagttttgtctggggtttcttggtaaggtgacctgatggatcttcaggcccaaggggtcctggaagggcctagagactgccagagtggaggaggagctgttaggatgtgggagcaggggcttctctgggtcccgcagagatgtgttctcctggcatgggccaagggccccctggaggaggctgcactttcctgatccctcccaaggtttccaggcctgctcaatggctcagacccactgccccagtttcttctaccctcgggaagttttgacgaccagctggatccctctcactccctcctaactccctcatctgggaggggtgcgggaggcatgggtatttacaaggagtcctgtaggtgattcggtggccattcccagcccctcagaagaactgaagggagatgaaggaaatgtcctttgaaggtggcagtaaaagaaattaagtgctcaccacaccagcagccatgtcctatccccaaacacctccatcccttcttcaaccgggaactcattgttttaccactgtgtgccccagcagctcacttgggtgggctccctctgccgggggagttcctgggtgcgtcacccactcccacgaactccttttctcttccaggcctgcctcggtctcgcagtcagacgtgcctgccagagctgctgcggtttctgggtcagaacgtgcatgcccggaagaataagaacgtcgacattctctggcaagctgctgaggtactggttacagagaggaaaaggaggctattgcggtgcccacagctgaacgtcatgacagaaacattacaaagtagaatctcagcaggagagcagagctctccatactgggagaggagggagtcactgagtacgttctgaagctctgaaagagactgaacagttcacagagtccattcctttggggctgcctgaattctgataagcttaacacagtccatctcttggggcatttactagccaggctgatgacagttgtcaccctcagaagcctggcgatcgataccagctgaaaaccactgtctactgcatcatttaatagggtcagaaggaggccatgtgacctttcaggtctctttaaaccatctttatcgtccattgtgcctctgatctcctcattttcccaagcacttaccctgctcatattttctccaaagtttacttgtggaattccaagccactgctctgagcctgggtaacagaccaatttcatagctggtcattcattcacccttgatgaggggcgaggttaattcttctccacagcagcataacctgcccagcgctgggactcgggcacacatggccccagtggcattcccgctccctgcctgggcctgaggagagggatggtgagcccaggagggaggtggcactgcactgcccaccacacctcagccaccacgcctcgtcacagagctcgagcagcagagggtccagccctccacagcttccctgagcagctcactctgaagtgtgcctctccgtcttgtcaggaaggtgcttctctcagccccgagtctcttctacagcagcagaccgtctcagctgctcatggtgcatggccgccacttcgggttggttattagtcctgtgttcaagccgggcttcatgaagccgcactttttgaatgtgctccacttctgggtttgttaacagttgtggctgctgataccattttgttgaattcagctttaaagagtgaacattcccctccatcttttgagttcctcagctggtcagactttatctttgtgggaagcgtggggtggatcaatctgcaggtctcccctctctgggcctggctgccctctaaatcttttcattataacagaacacattttgaagcacaaagtgacaggaagttcggcaggtttctcaggcctcatttttgaggtatcctcttggttttggggcctcatctggcattgcttgctcaggccaggcccagcaagyggggtgtagggcagggcacacactggctacgggggtctctgcagcaggacagagggggctccctacttttatttttcctggggggttgctaaacccccctggccaggctgtgacagcctcttacctaagtaccttaagagattttgtgtgaaaagcaagcctttcccacaggacacgaagaatacagagggtggccgggctcggtggctcacgcctgtaatcccagcactttgggaggccgaggtaggtgagtcagctgaggtcaggagttcgagaccagcctggccaacatggtgaaaccccatctctactaaaaatacaaaaattagccaggcgtggtgacgcatgcctgtaatcccagctactcgggcggctgaggtaggagaattgcttgaacctgggaggcggaggttgcagtaagccgaaatcacactactgcactccagcctgggtgatagagtgagactccatctcaaaaaaaaaaaaaaaagaatgcagagggtgacacagctaggtgtctgaacagtggtgggggatgtgcgttcactgatgcgttctccttggaatacacacacaggcagtttacagacgagtagtgcagagaccttgtgcatatcttgtttgggaactgtggttctacctgtctattgccatataatagaaaaatcattaagtatagggacaactgaccatcccctgtcaccagaacagaaaagcagtccatcaagtcctgtatttcttgttcccagtagagatctcagggtaacaagcatgagtgtagaggtgcaaggctctcagagacccttggctgcatgggttctcacgttgtccaccgaatcccaggcatcccctggggataaggggttgtggggcagcagtgccagccactcaggtactgagtccttccatccccagtttgagcagagctgctctccttttcaggcwcttatttctttttgtttgtgtgtatgaataaagggtccctggctgaatagctggartatctttagtcaggtctaagcctatatctcatggatggggagacccagcagtgcaccacaagtggctggtgtccctctgggatggaagcctggcactgcagtgccctcttgggcaaggatgcatcactggccatccctgcctgccttccagaacctcacgttagctctggatgcagcatctatgaatttaaagctttttgaaacctatagttccagcttccgtcatgtgtttgggtcatgaactctacagcccacagaatttagtgcacataccaagttcactcttgctttgtcagttacaactttacaaatttgattaatttactctccattagcttagggtctgcttatctgcttagggcctgttatttttttttctttctttttgttggtctgttctcagaagaagcctattctccttctgattgtcttgcctgaacattgggtcttttgttttgcctttccctagacgaggttcttagcactgtaccatgttcgtgtctagtgatgatcctggtagtgactggcatgctctttggctttgctggcctgacaagcaggtgttgtgccatcttcaggagttgatgagacactgatatttttctggcatacaacagatacccggagcccaccatcatatcacttggatgatgtttcattaaataccagccttggtgtcatagtgcagtatctgatacggtgcatagtcctttatctgaagcccctgtggccagatgctttggaatgcacaggttttcagattttagaaagtactgtggtacacagttggtgtttacttatgtaagtaatatggtgcccatcgcatatgtgtaccatggtatacatacaggatttaacatccccgggggagcctgagacagcactctgcaaccaagctcatattattgccacactgaaaagtatgaatatttacataaaatgggataagtaaagattgcaagtagtcttatatcagctcaggtctggttgtgctgccaaatgagattgccacagatttacacgaaaaaattaccttgtttcagagcttgatggatttggtgactgtgtgcctaggattgtatctagaggtgcagggaaaatgccctgaaatctccccatggggagaggaggtgcactcaggtggccttttcccagtccagaggctgccctgccccctactctgtgagccattcagttgtgaggagggaagtgtgctggcagtaactctgctaccgggaaagtatggcgggaggaggcctgtggggctggtggtcaggaggtggccaaagggcagtgcaacttctgagctgctcccgtctgttcaggtgaaagaggagagtagagatagtaggtctgttccctaccttccagggagacctrgagacctggcccaggactgtgggcatcctgagagtggctctggcttccccagtgggtcatatttgccgccctctttccctgagggatcagcagtgaagggctgaacgtgataagagggcccaggcatggcttggaaggggacagcggactgcaaaagagtgtcctgtgggagaaggcaggccacacaggggatggcagggatgatggcaggcctacaggcggcaggcccccaaaagggctggtgtctgtaagtgacttggtttctattgccagctctggcagggcatggagttggggaacaaaattggagcgtctggccaggcctgggtgttgagtttctgttcctgcccttgctgggctggttgggagcctttcctgtgtgtgaagggtgctgcctttctgtggagcctcgcctctaagcacggcccatgtttctgttggcagatctgccgccgccttaatggggtccggttcaccagctgcaagagngctaaggaccgtacagccatgtcggtgacactggagcagtgcctgatcctgcaacacgagcatggcatggccccgcaggtcttcacccaggccctggagtgcatgcgcaggtgagtgccgcagccaggccgcgcgccccgcctgccccggcccgtgtaaactgcagatgagctggtaccctgctcctgcctgcagggcctaccctgcatgagccccttgactccagccttcacacttgagtttgacaaacccgtcaaactattggcactatcaaattcagacagggttctcttgtaaggtaaggtggggggtaacagctagcaggactttctgagcaggactgcccagaaaactggtagactggtgggcaagccacgggtcaggcagctaaacgggaagctgggaagcagccatgacatgcagtgccctgttggccacctgctggccgtgggtgtgacttagggccagtgctttctcagcaggcatctgctgttgtcgtcgtgtatatattgatatctgtacatttccaaacttgagtgaagcaacgcgtctgcaggttgcatcggtctgctctgctgcttctctagcagtcgacaccatttgctcttatgagcaaagtgtcaaatgagtgttttatcatgagagctgtcagtgtgctctggcgacctcaccctaatgatgttctgattctgaggcagcaggcgtgtttgcagaatgaaacccggaactaaaagtgtctactgttgatcgatgccttgtttcaagcactgctgggcagccccctacctcacataccaaaagaaaggataagaaacctggtttcccgtctccttcgatgtagtcaccaatgctgttaaagtctcgtttccaacagtcacttctactaaatgttctgtatcatttgtcctctcaccaaattatttaaagtgttcaattctcttatcctttctgtatgtttctgccgtttgaccttctcacaatactgcacaaaagcgacgcgtgagctcctgcctcttgataagtgcattttgtaaaaatggaatcgttttgtcccgttttgtctttccaagttcatctcaacctctctgttaaagctcgccatccctctgcccaggctcagggaagcaatggagactcaaagaccggtgctctggggcgcctttttaaaattttaattccctggtctgctccccaggagccttggtgccattcaggcctgatgtccagtgtgaccctggtgctgagggacggcagccacgcctgtgcccattagctgcacggtggtgggaggggacattctggtgagctgcagacctcagccagtgaagaaaggagaacaaagtggacagggatccctgtggtagtggcagcaaggagcaggatcagggccagtcaggagctggcaccccaagttaggcacacagtccatgcggaaacctctactcagttctcgggctctcgaacaagttcaacggaaacaattcattctgaccacctctgaacacaaagacctcaggagaccagtgacaaagtggccccctggagagccacmgtgygatggcaggcctgtcactgagcccagacccgcaagggccccayccgcctgcccctagcmcacttgggttgtgtgctcaggacagccgttacagttacagctgttaggatgtatagtgcacaaagcactttttataacttttactcacataaggaattgaaaatccttgtaggaaaattaggaaatacagataagcccctacacwagttcctcagaaccctcccacaaagaatcccccagtttcctaatgtgaacaggtagcgctgcggacatttggatacatactgtctagataagagacatgcgtacatgcctatgggcgtgagtatgtacacatgggccaaccagtccctgaattacacagaacaaaaacacccacatgcacaaacaagtgtaattatatttgcaaataacagtcttgtgagcattttttaggttaataaatgtagaccttatcactttttttttctttttttttttttgagatggaatcttgctctgtcacccaggctggagtgcaatggtgcagtcttggctcactgcatcctccacctccagagtttaagcaattctgcccttgcctcctgagtagctgggattacagatgcccaccaccacacctggctaattttttgtatttttagtagaaacggggtttggccatgttggccgggatgttctcaaactcctgacctcaggtgatccgcccaccttggcctcccatagtgctgggattacagacgtgagccaccatgcccagccgcattttacacactataatttatccaatttgctgtcattgaatatttaagctgtatatggttttccagcattttaatcaaaggtgcagtgaatatccttatacattcccctagccacattgccttaggttaaaaagtatacacctttgtaaggcttttgaataattttagtacagatcaccaaatggtccccacagtagccactctcctgcccagtgtcccagagtgcacgaggcactgcccatgccgggcgctgtctttcctgtcactcttgtgaggcttctgaagctgtaagggctgttgtttctctgcattagcagtaagggccctggggcctggcaaagggaaggcccttcctcctgtgggaacaggcagcattccctccaccctgccctcttcctttctaaaccccacccctgcctccaatcatggatgccttttttacttgcttatttctttgttttctgaaatctctacagtgaacatgtatcactttaatagtttttaaagaagttataaaaacaaaacaaagctcaatcctactttacctgtgcctgccccagaattctcgcaccagctctggggacatggctcactgccaccttgagccaacccttgcaggtctgaggctcttgtcacaggcatttgttttaaggtgacttctgttttcgatacgatcccatgaggggaagacatgtacctgttcaggcggctgcaagccgaggtggctgggtcacaagctagcagctctggctgctggggtgccgagtacctgcagtttagctgagggccccagaaggcagcataaacttccaccctgcccgtgggtgcaggaggacattttggttcctggctttctggcttgcatcttatcagacggaagagtagagcatgcaggtgggggtggagggggtgggggccaagctggcacccaggcttttctcctggaggcccagggtgaaccatggccagtgctgtgctgtaaatgttcagccaccagctctctccccaaaagccctgatctgtaatgtttgccatttctgtggcataaacgcttctaccagggcccatttcaagctcccatgtggcaccattgaacatggagttgggaagagattcacacatttggccactggggtgttcctgtccccagtcctggggctgaacccctcgaagtaggccttcctgagtagccacagggccctgccagcctctcctggcagggaatgtggcagtgggtcggtgctccgcagcttgggaattgtgccctctcagaatggcacattccagcagggccatgggggcttcggggctcctctgggagagctggggagggctctgtgtgaagaggaaccctgggcctcctgcctccccatctccaagtggagccttcacaggctgcctgctgtgtcctcaggcctctgattctgtgtcactgctgccacttggcagacataaatgtgcttccagagtcatgtggttctaggtaccatctcacctcagtgcagttcttctgtagcaccaaaagggggaagaagccccaaatttctagtgtggtattgtttggattccacccttggggatgctttcagaaccctaacttgcaaagatggaaacagcagtcgctcatgcctgccactgctgagcctggaacccgaggcggggctggtgggggctctgcgcttggttggttggtacctgaggtaaatggtttttgtttgcgtggttgatcaagaggcagctttggccaaatcctttgtaccaccccctgctcaggcatctgtgagaaggtcaaatccccaatggttcttcatgttccgcttgcttctcagaaatccctgtctgtgcagcatgtgggggcatggccgggcagcatggagttgtgcttggccagccgagagagtgaacatggaaaaccattcgttcaacctacatgtgtttattttcagtagattgcagtattttttcttattttcacttctctttctctccttttttcctgtaactgtgctggttttgttttggtcttcctctcatacccgtttctgcatttcatcttttctttctattgtgacttcatttcatttttttttaaccttatcttttgtttctcttgtttatcccatcctttttgataaaatccatcgcatgtgtcttctttttttctttattttctttcctttcctttttcctttttctttctcccaaactttttccttttcacagcattggaacacgggaggtagtcacccagaagaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaacatgtccagccaccgtgtacctaactggacagaaggaatgtgtcaaaccgtggtctgccaagaaatatttcatgccttacattttgacgttttgttcttctgaactgtaaatatctgccaaattatttcaccaagaagacttgtttgtttagctcctgtagcatcttcagtgcttgtaacatgttcttacggtgccctgtcactgcatcgtttagctggcctggaattccttgtaccacrtctctaccttctgatgtacaactatttatcacctgtacctctcatgtgccctgtttccaagagaaacgagttctgtttaaagagaatttgtatatttgatactattctttaagtgtactgctaacccttcctttccttttgatgacaaacgaaaagaaaaaaacatgctttataactggcttatctagaaaaacctatctaataggacatgtactttctgctttcatttcaaagcgtagtccctgaattacagtagcaaacagtttgcagaatcctaccatttccttgcttatgtttattatttccaattaaggatgacacaaagctgtgaatacagtagtacactgtagcaagagccagacacagtcagacacagaaagatcacctactgcatacgccagacacagaaagatcacctactgcatacgccagacacagaaagatcacctactgcatatgccagccacagaaagatcacctactgcatacgccagacacagaaagatcacctactccatacgccagacacagaaagatcacctactgcatacgccaaagaaagatcacctactgcatacgccagacacagaaagatcacctgctgcatacgccagacacagaaagatcacctgctgcatacgccagacacagaaagatcacctactgcatacaccagacagaaagataacctactgcatacgccagacacagatcatctactgcatacaccagacagaaagataacctaccgcataagtcagacagaaagatcacctagtgcataagtcagacacagaaagatcacctactgcataagtcaaacagaaagatcgcctactgcatacaccagacacagaaagatcacctactgcataagtcaaacagaaagataacctcctgcatacgccagacacagaaagatcacctgctgcacacaccagacacagatcacctactgcatacgccagacacagaaagatcacctactgcatatgccagacacagaaagatcacctactgcatacgccagacacagaaagatcacctactgcatgtgactttagatttactcttcactatgtaaggatcattcagctggttcaaggaattaatgcatatagtcaccaaaggctgttaaagttatatacttttatttattttaaaacagtatttttcatttaaaaaatggtatctttaattgcagattaaagttccaacatcttttctctcttactaatcaaatatgattgataatgaaaaaaaatcaaagaaaaaatgccaaaaaaaaaagtgatccctgacttgtgggcagttgcggtggatggagctgagagagcagcagggcgctctggtttctgctggtgccccctcagtcctcacgtggcattccctgcagcgcgatgaagtgtaaccttaacacccatgtagggcagagggtaattgtccacctgtaaaagtaaccaaatagatcaggaaaaactccccacaccctgtgcaggacggtcagcagcttctctgttttccagttcatattatgttgtgcctccactttctatctccagctggttccccatacactgtagtttatgaagacgattttttttaaccaggccagaaaaatgggaatgaatttagagaagcttgcttttccagaaacttgacacccatgcatgcccagaaacccagtcgaccacaaaaggcagcgagcgacctctcttcattatctctccaggactcccagaccttaccccgggctttttctcattcagtatcagctcagagtctgggtcctaggaatcacagaagcagttagcaatgaatggcaaatgctagactcaacactttacatcctaaaatgtaagaccatcatgagcactgcaggctccctggggcaggcatcacctgtgtgtcacccctgtaagtgaatccacgcttctccaagtgcagtgtgttcacttgtctcttctaaaataaatgaggtggctgttgtggcatagctcctggtggccttcagtagggagtctgaagtcaccaaacgccagctcatgggtggtgtaagctgtggcagcatgacaatagtccctgggcagtgtcctgtccagcctgtgattatttgaaaggcatgtttgccatgtttgccactttccctctttcacattgaggcgtgcacttcaactaagaccatcttgtttgctttatttgaaagcaagagagcagagtccacagcctcattcagttcccattacacagcttcctggtcctgctcctggtaacgtggttccaatgcctgtagtggtgacttacgtgcactcccacttccacagcagggctagtggctaggcagagcccatgcacagaggaaggccctctgactgcagacagcacccctccctctcccagggctcaaggatgcttctgtggcaccctccagggacgcctcccaggaccctgccccatagcacagagaagctgcggccaggccgaggagcccctcccagggggcctcaaggacaccacggcctgatccttgattgtcaccacacctttctgcccatgtgggcttggcccgtgggctgagagaaatgagaccaaagggagcgagataaggttctttgtttctctcctccagggtctgggtgaaaatcagtatgccgcctgtgcacttggagagctagcaaaaggacaccatgagattagcctaggtggtgggttggttttggctttttaaacttaaagtatttgagaaaagaaactcagttgctctccctttatgctgaattttaatgtcactaaggccttttactcatgaaatcaggccaaatacgtatgcaaaatcttacttgctttagtgagaaataggcaggatgaaacaaagatgggagatgattcaagaaaggggtcattgacatttagtgatggtttttagttgcttatactgtagtagtgctgaggcattgttgatgtcagccagctctaggtgttcagattaaatcagctttctgaagttagggaaaccacaatcaggagtggttctctttggatggtcttataaaattgttgtataagttttttcaactagtgtgacagtcactatttacgcctatggcttgattccagcagagattttaacacaatgacctgttttccctccacaaagtgacaggagtagcagccaccccatgctcagccatagaatcactaagatactgatgcctgcagatgagttctcaagtggaagaccccactggaaccggaaaactagaggattccctaaaattatctgtcacttggggtttccattttaattttcatttcaaaaatggatgcccttgaaaagaaataatttattgatataataaaagtaatcatggagctttgaaataattaagtccctcttgctaaaatctaagaccacctcaacatgtaccattggttcctaaaaagtatgcagccgacgtgatcagtggaggtgtcctgccttagggcagcagcttggcctctgcagcaggaaaccccagttagcacaggctgtcctcgccacctctgcatgcctcgccccgggccctcttgccagctcgtccgcacaggcaggtggtgggataacagtgtcggcatgtggatcagccacatcagccggatattgcaaattcaaacatctgggggaaagtaaatacaatttgatttgaaaactacgttgaaatgaaagtataatctttattagaatttcacatctgatgtgttcagccagctaaactaggcattaactcctttaacatgtaaataaaagataatgtcaaagttcacaaattattctgcctcgctcctcacggcagtttagcatttattagtgacaggtggtttttaagcagtttgtacatttctatataaatggagaagccatatctgaagtagttcattaatgtaagagtttccaaagattaaaggagattaactgtgtataggaacctatagcttctgctttaagtggaagtacgtttttgattactgaatgaatgttaggcaaacacgattgttacttactccagggggcctcctgtggcctaggtgttcagctcagatgacacacatctagctgaggccttgaggctccgtgacaagaaagcatatccaagttaccaaattagttacaacaaccaggtggatacttttctaaactatcggagcttagcttttgaataaaaaatactgtcttaccaaaagtattttacatgttcttsataatgagactgtcattttcactttaaaaggcttgagcaattgccactgatgttttttttttttaaatgcgtgacataatggtcttcatacaatttgaattttttaaaaaatcactgtttcttggtaactgcaaattttacatctcataaggggaattttgtactaaatttgataactagttgatttcactgctagtcttagaacagcataaaaccatcaagttatactgtgctgtgggaagtcatttatgtttaaaatcrcttttgctggttagttttatgtctacacctgaacatttcccagagaactccccggacgcgctcactgagtaggtgaggccccctggctgctcatcctcccatgcagtgtttgcttttgccccctggattgccatggcaaccctccatcagatgcagctgaggatgacgctggtagtgagttctctagggaagggcacctgtgggctctcactggctcagtggcacctgtgcaagagggaacacatgggggcagcccacctgtggaagggtggctggctgctaccagaacttggtgagatccctccctcataacattccagccctgattgccaggctgctctgcagacagtgcatgaacccattggattacctggcacccagaacaactgtcctccaggagacagcagaccagaacgccttcctagccagctggctttgctacatgttgaattctgcaaggaaagtcagcattttgaatttgatgtgattacagctcttgctaatacagaaaagtccggctctttaaagctctgaagtgcaactttagtaagagtagtaatatttctttttccacttcatttgctatgtgagggaatctttgaaccacaagttatgatagaaccccaaaagacatgagctacatgaaaccattcacttggaaaaagtttgcttccacttagatacagtgctgcttttaggaacgcacaactcacagccccacgcagcatgtgtccatctctgtgcttcttaattgccttgttcagaaacctgccatcttacatatgtatttgttgtaaatgagtccggcacccatttaaattaatcttttttttaatgttatgaaaatgatcagttcatttcatcttagtttaagtcttttcttttttccttttttactgccgtcatttcttgtgcttgttttttccccagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttayttttctacagagtaactcaaaagtaaccattgaattacaatccactttgtaaaaatctgaatgtaaaacagtaaataataaattaaataaytggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgasttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaayatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttktccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcracgcgcctcagaagtacgtgttcataaatggtagccattgttgtwaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgrcccgttatctcccttggaaaaattcctctcactggaaatgtacaattaaaggatgattgaaatgtttaactcttggagtttttagtattaccaaactcctagaaatttaagctaccaccaaaaataacatgtgccttttccctttattctcattgatggtagcagtgcacctcgtttcagtgtcctgattccttgattactgtgaacactgaacatcttttatacctttatgatatttctatgtttgtgacttcattggaatgttgatctatttcatatagattgtttttaatatacaatgtattagcccctgtcatatgttgcacactttttaacctatttgtcagctgtcttttggtctgtggtaggagttatacagtattttaaatggtttatgtagtcacatatacctgtctttcattttgatgcttgttctgaaatggagtcctggcttcaccatggaaggtgggacatatgggacagccatgtccttgtgggcatggtggtgtggctgcgtgcccacgacgaggggctggactaaagtgctcactggcaccttgcttggtgcatgggccatgctcagtttaatattattaacagtttctaccttcactctcatgtctcaggattattttttcagcatttacctgttcttatttctaggatgtttatggtttcagtcctacatttagatcaatccatctggaatcatcttggtgtaagtcctgtgttgtgcttacagtatgtaaagtcagagggaatccctcaaggtcaggcctaattttgcttctctttaaagttaagccaagaagaagacatgtcaggacgcccagacatcagctaccgtgagcttcttcctgccctccctccgcatgccattctggtgctgcgcttcagtttcctgttgagtctctgcttagtagatgacttggcacaatctggctgcccagatctaggggagttgtcccagggaggctttgcgctggaggaaggtaagaggagctggaggttggagcttcccgatttgtgatttttccaagaacagaaatgattagccatgtggggaggttacttcattgtacattgttctactgcataacctccctctattctttaccagcatcacacagcaggttggcaccatttttgaatagaggtttctcacagtatcctcagcagcattgagtgttcctaatgttgtagtaatgagcagtagatgtctctcagtgggcagtgtgacctctttggtcactctaaagggctgccagcatttctcttaagctggggggagaagagctgttctgtgtataggggtattgggaacacatggacagaaggaactggcctcacatgccatcgtgttcctgggatggctcttccaagaccagcagttcctcctggcaggcaggccctcacagaactctgcatttggagatggacaaactctcttcttcttatcactttctccccaaaatgtcctcttctaccagcccctcttaagagccgattttctgtaagttatagtgagggcactgctctgctgtgcacagaaggaaccccagcccagaagcacacgctccctgtggaacctgcaggggtggcagtgatgacagaaccaagggggtcaaggaagattggagaggagtgggcagcaggaaacagctcaggctgcctgacctggcccccggctgcccatgagggcctccagagaggggcagagctggcttatcgggatccatgatggtttttacacttttaaaagtgccctcttctcagagaccctggttatttccaaaagtaggaagtaatcaaatttacagtggataaaatccagtatttgaaatcaggaagacagaaaaaaaagcaaaatagcatccttttctgagaggtatatgctgaccaaaaagatctttcattcctgtgaacaccaagcagcgcggcctctggcagagagagcgctgggttgtacagatggaaacttgtgtttagcaggctgtctgctcccaatagtggccctggctgcaactgacctcctgatgccctgctgacgctaactgtgggtaccaaccagcaccgtggacatcggccccaggatcagtctacgatttgtctggtggccaaatgatgacttttgagtgggaaaagctggtgggggctacaccgtgctctgcagtgtagtgggatcctgtgagctggcctgcacaggcactccctcccctgccaggggccccagggaggcttctccagcctgaggctgcaccctccatacgattccaccccccatcctgtgccaacagtaggcaaacggagagtagcttggtcttgtttttattagctgttgccctccaggctacgacagggttcccagggtgtagcctgaaaacacccatactctagattccctccactggaaccctgtctttgccatgatttcttcctgcatcaggcccctgtgggccttgcaggccagtccaggcaggtctttcacactgttgtcccacataacagaaaaagctgagcagacagggtaggaaacacacttgcatctccatggctccaaagaggatgcctgtgttagatggatgtagacagacacagcacttcactgcttcctcctcctcgccacccagccctccctcggtgtctgtggcctgactctctcctggtggtcctacgtctctgaccatccctcctcactctcaaattttatgttgcccaccacctgccactaatggcgtggtgttctcctgggttccctttctcacttaagatgatcttcctgaaaaatcttacacattcctgttgaacaaatggtcacttatatggtagtgactcctaaatttctaggtccatcccagactctcccccaaggtccagattacctatacatctaagcaccatgcctgtcttgcaggcatctcaaatacagcatgctcatgcctctcctcctccaagctggctgagtctccctctaatagacgaccttgggatcattttctcctccacatcccatcaatcagccactgaacctgtatctcttgagaaccatcccataatttccatccatgcaccccaaggcctggtctgtatcagtcccctcggatctggacctctcctgagcatcctcacccctcctgcaaggctagtctcaggtctgccttcctctatggtgatttctccccacaaatgaagttggccctttcaaaaaaacttcctctccttcattgttgactatgaagattctttcatgcatgtcctgtccactgtcagtcccctctgtattcacaagagcaagtgtaatgcccgctgtgaaggagctaaagtttgttgaataaacacatgaacaaatggtggttttgtggtgttcaactgaaatatttcctatttcagcactggaccacgctgtttttctcactacataatcggttacgctaaatgcatcacgagccaaattcaaaaggtcaaaggagaaggcaaatggcagagtgtggtaaaggggcgagtgagagggtctctgaaaaaagtcaggctaaaattacagggggttcaggcaatgttatcttgatctggatggccagttacatgacagattactttgttcttaacatacgaacatcctattcactttttggtatactggttgtttaacagtaaaaattaaatgtttaaaacccaccattactgagaatgatgatttccaatttcatccatgtccctacaaaggacatgaactcatcattttttatggctgcatagtattccatggtgtatatgcaccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccacacctgttgtttcctgactttttaatgattgccgttctaactaactggtgtgagatggtatctcatcgtggttttgatttgcattcctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctgtgtcctgaatggtaatgcctaggttttcttctagggtttttatggttttaggtctaatgtttaagtctttaatccatcttgaattgatttttgtgtaaggtgtaaggaagggatccagtttcagctttctacatatggctagccagttttcccagcaccatttattaaatagggaatcctttccccattgcttgtttttctcaggttcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagcgcaccagcatggcacatgtatacacatgtaactaacctgcacaatgtgcacatgtaccctaaaacttaaagtataaaaaaaaaatagtcaccaactacattcaaaccatgagagggtagctgcagatttaaattctctgaagtaaagttgaatcattatctctgtattaaataggttgacttctgagtgatgaaccttacttcttccaaggagctttcccacgtccctgctactacataacaaggtttatttaatatgtcttttcttaattttcccatagcacattttaatatttttatcagggatatgtaataataccattccataattaaaatagaatatgagacataaaaggtaaaacaataatgatggtgtaagtattatagaaaacataatacatgtactatctttgaaaaattttagagctgtagtttgcacgatagaaaatatatatcaacatttcatcacatcagaaatatatgcaatgttagatctattacattgtgacattttaggaaaaaaagaactgggattttacttttgtattcctaagattgtggccagattttgaatgactaatatttatagaattgaattaaatgtatttctaaaagtttaaaaaaaaaacaacccaccattgttgaacaatctccaaaggaaattaaggaaacagttctatgtacagtagcatcataaagaaaatactcaggaataaacaaccaaagaggcaaaagtcttgtatattgaaaactacaaaattttgctgcaaagaaattaagaatgccaaaaaatggaaagacatcttgcgcacatggattgaaagacctaatattgttaagatgacagtactatcaaaagtgagctacagattcaatgtaccccccccccatcaaattcccaactgatttttttgtgtgtggaaatagaaaaatccatcctaagatttacatcgaatctcaaggaaccccaggtagccaaaacaatcttgaaaaagaacaaagctggaggtcgcatacttcctgatttcaaagcttattattacagagctacagtaatcaaaataatgtggcactggcataaatatgtacagacagaagtgcagaatagaatagcatgcccagaaataaaccctggcatatatggtcaaatgattttccacaggatgccaagaccattcaatggggaaagaaca
